United States Patent 11,098,302 (IDENTIFICATION OF POLYNUCLEOTIDES ASSOCIATED WITH A SAMPLE) - sequence listing, part 181

SEQ ID NO: 791437 - DNA, 706 bp, Homo sapiens
  misc_feature: 30809.UNK.UNK.UNK.pb.heavy.1.raw 30809
cgtatcgcctcctcgcgccatcagacagtatatacacggaccggtgctcgatttagtagtcgcataaagggaaaggggagctctgagagaggagcccagccctgggattttcaggtgtcttcatttggtgaccaggaccgaacagagagaagtctccatggagtttggctgagctgcctttttctgtggctttttaaagggtgtcgtgtgtgaagtgcagttgttggagtctgggggggcctgattcgggcctgggaggtccctgaccctctcctgtgcggcctctggattcacctttagtgcctatggcatgacctgggtccgccgggctccagggagggactggagtgggtctcaagtatcggagctggtggtgtcacttttctacggagactccgtgaaggggccgcttcaccatttccagggacaattcgcaggacaaattgtttctcaaatgaaaaacctgagacccgaggacacaggcgtctattactgtttgaaagccaggaccacggtgaccccccatgacacctttagtacttggggccgggggacagtgtgaccgtctcttcagcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 791438 - DNA, 680 bp, Homo sapiens
  misc_feature: 30814.44.53.E09.1.pb.heavy.1.raw 30814
cgtatcgcctccctcgcgccatcagacagtatatacacgaccggtgctcgatttagagagagtgtgttgagctctgggaagaggagccccagccttgggattcccaggtgttttcattcagtgatcaggactgaaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggttcattcgggccaggaaccctggtcaccgtctcctcagcctccaccaagggcccatcggtcttccccctggcgccctgctcaggagcacctccgagagcacagcgccctgggctgcctggtcaaggactacttcctatatactgtctgagcgggctggcaaggcgcatag

SEQ ID NO: 791439 - DNA, 690 bp, Homo sapiens
  misc_feature: 30828.44.71.G05.1.pb.heavy.1.raw 30828
ctatgcgccttgccagcccgctcagacagtatataggaagtagtccttgaccaggcagcccagggccgctgtgccccagaggtgctcctggagcagggcgccagggggaagaccgatgggcccttggtggaagctgaagagacggtgaccattgtcccctggccccaatatcaaatgcatcgacgtcccaggatcgcctggcgcagtaatagacgcctgtgtcgtcgggtctcaggttgctcattgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacaccttctaaaaaaactacaaggaaaatcaagattagcccaaactccatggttggtggtctgtgctcagtgctgatcaccaagtggaaactcctggaatctcacggctggggctcctctctcttgcgacgacactaaatcgagcaccggtcgtgtatatactgtctgatggcgcgagggaggcgatacg

SEQ ID NO: 791440 - DNA, 698 bp, Homo sapiens
  misc_feature: 30829.UNK.UNK.UNK.pb.heavy.1.raw 30829
cgtatcgcctccctcgcgccatcagacagtatatacacgaccggtgctccgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactggggccagggaaccctggtcaccgtccctcagcctccaccagggcccatcggtcttccccctggcgccctgctccaggagcacctccgagagcacagcggcctggctgcctggtcaaggactacttcctatatactgtctgagcggctggcaaggcgcatg

SEQ ID NO: 791441 - DNA, 618 bp, Homo sapiens
  misc_feature: 30851.UNK.UNK.UNK.pb.heavy.1.raw 30851
ctatgcgccttgccagcccgctcagacagtatataggaagtagtccttgaccaggcagcccaggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctccccggactccaccagctgcacctcacactggacaccttttaaaatagcaacaaggaaaacccagctattcagatactaaatcgagcaccggtcgtgtatatactgtctgatggcgcgagggaggcgatacg

SEQ ID NO: 791442 - DNA, 676 bp, Homo sapiens
  misc_feature: 30870.44.53.E09.1.pb.heavy.1.raw 30870
cgtatcgcccccctcgccgccatcagacagtatatacacgaccggtgctcgatttagagagagtgtgttgagctctggagaggagcccagccttgggatttcccaggtgtttcattcagtgatcaggactgaaacacagaggactccaccatggagtttggctgagcctggattttccttgctgctattttaaaaaggtgtccagtgtgaggtgcagttggtggagtctgggaggtttggtaaagcctgggagtccttagacttcctgtgcaagcctctggattcactttcagtaacgcctggatgaacctgggtccgccaggctccaggaaggggctggagtggttggccgtatagaaaccaaagctgacggtggggacagccagactacgctgcagcccgtgaaaggcagattcaccatctcaagagatgattcaaaagataccgtgtcttctgcagatgaacagcctgaaacacccgaggacacagccgtctattactgtctgggatggttttcattcgggccagggaaccctggttcaccgtctcctcagcctcacaagggcccatcggtcttccccctggccgcctgctccaggagcacctcgagagcacagcggccctgggctgcctggtcaaggactacttcctatatactgtctgagcgggctggcaa

SEQ ID NO: 791443 - DNA, 688 bp, Homo sapiens
  misc_feature: 30907.44.36.D03.1.pb.heavy.1.raw 30907
tgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcgttttcagttagtcattcgcagaatcaatgagttcttgaagtcatctcttgagagggtgaatctggctttcacagacgcggcgtactctgtgataaagctggcaactttgtttttactgcggcaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctgggctccgctctcagagctccccaagagagatcgtgacgcagctaaatcgagcaccggtcgtgtatatactgtctgatgcgcgagggaggcgatacg

SEQ ID NO: 791444 - DNA, 648 bp, Homo sapiens
  misc_feature: 30924.UNK.UNK.UNK.pb.heavy.1.raw 30924
cgtatcgcctccctcgcgccatcagacagtatatacacgaccggtgctcgatttagtatggtagattccgcgggctttctgagagtcatggacctcctgtgcaagaacatgaagcacctgtggttcttcctcctgctggtggcggctcccagatgggtcctgtcccagctgcagctgcaggagtcgggccaggactggtgaagccttcggagacctgtccctcacctgcactgtctctggtggctccatcagcagtagtagttatactgggctggatccgccagccccaggaagggggctgagtggattgggagtatctattatagtggagcacctactacaacccgtcctcaagagtcgagtcacatatcagtagacacgtccaagaaccagttctccctgaagctgagctctgtgaccgccgcggacacggccgtgtattactgtgcgagagtaggcagttcgtcaccaactactttgaccactgggccagggaaccctggtcaccgtctcctcagcctccaccaaggcccatcgtcttccccctggcaccctcctccaagagcacctctggggcacagcggccctggctgcctggtcaaggactacttcctatatactgtctgagcgggctggcaaggcgcatag

SEQ ID NO: 791445 - DNA, 667 bp, Homo sapiens
  misc_feature: 30963.44.6.A06.1.pb.heavy.1.raw 30963
ctatgcgccttgccagcccgctcagacagtatataggaagtagtccttgaccaggcagcccaggccgctgtgccccagaggtgctcctggagcagggcgccaggggaagaccgatgggcccttggtgggaagctgaggtgacaatgaccagggttcctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccaacccatccactcaagccttgtccagggcctggcgcacccagttgatggtataagtagtggaactggtagtacttcagaggccgtgcaggaaagggatcaccgaggaccaaggttgcggccatttctagtccagactgcaccagttgcaccaggggactggacacctgttgctgctgcaccacaaagaggaacctccaggtccagtccatggtgactgtgctccaggggcttctttagaggaggaatgtggttgtcagtagatctaaatcgagcaccggtcgtgtatatactgtctgatggcgcgagggaggcgatacg

SEQ ID NO: 791446 - DNA, 695 bp, Homo sapiens
  misc_feature: 30964.UNK.UNK.UNK.pb.heavy.1.raw 30964
ctatgcgccttgccagcccgctcagacagtatataggaagtagtccttgaccagcagcccagggccgctgtgcccccagaggtgctcttggaggagggtgccagggggaagacgatgggccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaccgtgttcctggaattgtccctggagatggtgaatcggcccttcacggagtctgcgtagtatgtgaaatcaccagtataaatgactgagaccactccagcccttccctggagcctggcggacccaactcatgtagttgctgctgacggtgagcccagaggctgcacaggagagtctctgggaccccccaggctggactagcctcctccagactccatcagccgcacctcacactggacaccttttaaaagtccaacaaggagaacccagctcagccaaaactccatggtgagtcctctgtgttcagtgctgatcacgaatggaaacacctcggaatcccagtgctgggctcctctccccaaaacccaacgtgcgagtgctaaatcgagcacggtcgtgtatatactgtctgatggcgcgagggaggcgatacg

SEQ ID NO: 791447 - DNA, 690 bp, Homo sapiens
  misc_feature: 30987.44.27.C05.1.pb.heavy.1.raw 30987
cgtatcgcctccctcgcgccatcagacagtatatacacgaccggtgctcgatttagacgcgatcgaagggtttggggggaagaggaagtcgccggtgtttccactcggtgatcatcactgaacacagaggactcaccatggagtttgggctgagctgggtttttcctcgttgccctcttaagaggtgtcatgtgtcaggtgcaattcgtggagtctggggaggcgtggccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactactttcctatatactgtctgagcgggctggcaaaggcgcatag

SEQ ID NO: 791448 - DNA, 653 bp, Homo sapiens
  misc_feature: 30996.44.53.E09.1.pb.heavy.1.raw 30996
cgtatcgcctccctcgcgccatcagacagtatatacacgaccggtgctcgatttagagagagtgtgttgggtttggggggaagcacctgtggttcttcctcctgctggtggcggctcccagatgggtcctgttctcagccgcagctgcgggagtcgggcccaggactggtgaagcctttcggagaccctgtccctcacgtgcacggtctctggtgcctccatcgacagaagtaatttctactggggctggatccgccagccccaggagaggggctgcagtggattgggagtctctattatagtgggaacaccttactacaacccgtccctcaacggtcgagtcaccatatccgtggacacgtcgaggacacagttttccctgaaagtggtttctgtggccgccgccgacacggctgtctactactgtgtcagacatggtccgcctatggcaggtcgtctcaattctactacgcttgggacgtctggggccaagggaccacggtcaccgtctcctcatcctcagcctccaccaagggcccatcggtcttccccctggcgccctgctccaggagcacctcgagagcacagcggccctgggctgcctggtcaaggactacttcctataactgtctgagcggctgcaaggcgcatag

SEQ ID NO: 791449 - DNA, 680 bp, Homo sapiens
  misc_feature: 31031.44.53.E09.1.pb.heavy.1.raw 31031
ctatgcgccttgccagcccgctcagacagtatataggaagtagtccttgaccaggcagcccagggccgctgtgctctcggaggtggctcctggagcagggcgccagggggaagaccgatgggcccttggtggaggctgaggagacggtgacaggtgttcccctggcccgaatgagaaccatcccagacagtaatagacggctgtgtcctcggtgttcaggctgttcatctgcagagacaccgtatcttttgaatcatctcttgagatggtgaatctgctttcacgggtgcagcgtagtctgctgtcccaccgtcagctttggttctcaatacggccacccactccagcccttccctggagcctggcggacccaggtcacatcaggccgttactgaagtgaatccagaggctgcacaggagagtctaaggactccaggctttaccaacctcccccagactccaccactgcacctcacactggacacctttaaaaaatagcagcaaggaaaatccagctcagcccaaactccatggtgagtcctctgtgttcagtcctgatcactgaatgaaaacacctgggaatcccaggctggggctcctctcccagagctcaacacactctctctaaatcgagcaccggtcgtgtatatactgtctgatggcgcgagggaggcgatacg

SEQ ID NO: 791450 - DNA, 702 bp, Homo sapiens
  misc_feature: 31041.44.36.D03.1.pb.heavy.1.raw 31041
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggccatcggtcttcccctggcgccctgctccaggagcacctccgagagcacagcggccctgggctgcctggtcaaggactacttcctatatactgtctgagcgggctggcaaggcgcatag

SEQ ID NO: 791451 - DNA, 677 bp, Homo sapiens
  misc_feature: 31055.UNK.UNK.UNK.pb.heavy.1.raw 31055
ctatgcgccttgccagcccgctcagacagtatataggaagtagtccttgaccaggcagcccagggcgctgtgctctcggaggtgctcctggagcagggcgccaggggaagacgatgggcccttggtggaggctgaggagacggtgaccaggttccctggcccagtgacagttcctgatataaacacaacacaataatacatgccgtgtcctcggttttcaggttagtcattcgcagaatcaatgagttcttgaagtcatctcttgagaggtgaatctgctttcacagacgcggcgtactctgtgataaagctggcaactttgttttactgcggccagccactccagcccttcctggagcctggcggacccagtccatatagtggtcactgatggtgaatcagaggcgacacaggagagtctcaggaccctccaggctggacaagtctccccggactcaccaactgcacttcactctggacaccttgtaaaataacaacaaggaaaaccagctcagccgaactccatggtgagtctctgtgttcagtgctgatcaccaaatgaaaacacctggaattctgggctgggctccgctctcagagctcccaagagagatcgtgacgcagctaaatcgagcacgtcgtgtatatactgtctgatggcgcgagggagcgatacg

SEQ ID NO: 791452 - DNA, 699 bp, Homo sapiens
  misc_feature: 31080.44.73.G07.1.pb.heavy.1.raw 31080
cgtatcgcctccctcgcgccatcagacagtatatacacgaccggtgctcgatttagctctacgctcaggggggagaagacgagcccagcactggaagtcgcggtgttccattcggtgatcatcactgaacacagagactcagcatggactttgggctgagatgggttttcctcgttgcttttaagaggtggccagtgtcaggtgcagcctagtggagtctgggggagaggcgccccagcctcgggaactccctgagactctccctgtgcaggcctctgggattcatcttcaggacctatgccatgcactgggtcgcaggcctccaggcaagggctggagtggggtggcaattatatcagaagtatggaaattgaagaacactacggagactccgagaaggggccgattcaccgtctccagagacaattccaggaacacactgcatctggcaaatgtacaacctcacaagtgaggacacggctgtctattattgtgcgagagccccctcgagacggtcccgcttgatctactggggccaggaaccctgggtcacccggtctcctcagccctccaccaagggccatcggtcttcccctgcgccctgctccaggagcacctccgagagcacagcggccctggctgcctggtcaaggactacttcctattatactgtctgagcgggctggcaagggcgcatag

SEQ ID NO: 791453 - DNA, 650 bp, Homo sapiens
  misc_feature: 31086.44.86.H09.1.pb.heavy.1.raw 31086
cgtatcgcctccctcgcgccatcagacagtatatacacgaccggtgctcgattagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggccaggactggtgaggccttcgggaaccctgtctctcatctgcactgtctctggagtttccatcagttctgatcattcttggggctggatccggcagccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcataa

SEQ ID NO: 791454 - DNA, 617 bp, Homo sapiens
  misc_feature: 31097.44.23.C01.1.pb.heavy.1.raw 31097
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcaa

SEQ ID NO: 791455 - DNA, 610 bp, Homo sapiens
  misc_feature: 31113.UNK.UNK.UNK.pb.heavy.1.raw 31113
cccgaacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791456 - DNA, 718 bp, Homo sapiens
  misc_feature: 31125.UNK.UNK.UNK.pb.heavy.1.raw 31125
ctatgcgccttgccagcccgctcagacagtatataggaagtagtccttgaccagcagccagggcgctgtgctctcggaggtgctcctgggagcagggcgccagggggaagaccgatgggcccttggtggaggctgaggagacggtgaccagggtcccctggccccagtcatgcgcccggtaataactactaccacctcccgatctcgcacagtaatacagagccgagtcctcgactctccaggctgaccatttccaagtaaccacaatgttccgggaattgtctctggagatggtgaatccgcccttcacggagtctgcataatattcagaacttccatcatgtgctataactgccaaccactcggcccttgcctggagcctggcggaccccagtgcatgcccagaacccactgaaactaaatccagaggctttcacaggagaggtctctcagggacctcccaggctgaccacgcctcccccagactccaccaggtgcacctgacagtggacacctcttaaagagcaacgaggaaaacccagctcagcccaaactccatggtgagtcctctgtgttcagtgctgatcacaccgaatgggaacacccgccgactctagttggctgggctcctctcccagacccctttcccttcacactacactaaaatcggagcaccggtcgtgtatatactgtctgatggcgcgagggaggcgatacg

SEQ ID NO: 791457 - DNA, 712 bp, Homo sapiens
  misc_feature: 31129.UNK.UNK.UNK.pb.heavy.1.raw 31129
cgtatcgcctcccctcgcgccatcagacagtatatacacgaccggtggctcgatttagtgtagtgtgaagggaaagggttctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcggaggtggtagtagttattaccgggcggcatgactgggggccaggggaccctggtcaccgtctcctcagcctccaccaagggcccatcggtcttccccctggcgccctgctccaggagccacctccgagagcacagcggccctgggctgcctggtcaaggactacttcctatatactgtctgagcgggctggcaaggcgcatag

SEQ ID NO: 791458 - DNA, 734 bp, Homo sapiens
  misc_feature: 31152.UNK.UNK.UNK.pb.heavy.1.raw 31152
ctatgcgcccttgccagcccgctcagacagtatataggaaagtagtcccttgaccaggcagcccagggccgctgtgctctcggaggtgctcctggagcagggcgccaggggggaagaaccgatggcccttggtgggaggctgaggaagacggtgaccagggcttccctggcccccagtagaacgatgggctcgtacaataatagagagccgagtcctcggctctcaaaattgtttcatttgtagataccacggtgttcttggaattgtctctggagacggagaatcggcccttcaacggagtttcccatagtatttctttacttccatcagaccagatgactgccacccactccagccccttgcctgggagccctgggcggaacccagttgcatggcagaagtcactgaaactgagtccggacgcaaacacaggagagtcttcagggacggtccccagggcttggacccacggccttccccccagaactcccaaaccagctgaacctgacactgggacacctctttaaaggagcaacgaggaaaaaacccagctcagcccaaaaactccatggtgaggttcctctgttgttcagtgctgatcaccgaatggaaaacaacccgccgactttctagtgctgggctccctctcccagccccttttcccttaactgactcactaaatcgagcaccggtcgtgtatatactgtctgatggcggcgagggaggcgatacg

SEQ ID NO: 791459 - DNA, 662 bp, Homo sapiens
  misc_feature: 31172.44.35.D02.1.pb.heavy.1.raw 31172
ctatgcgccttgccagcccgctcagacagtatataggaagtagtccttgaccaggcagcccagggccgctgtgccccagaggtgctcttgaggagggtgccagggggaagaccgatggccttggtggaggctgaggagacggtgaccagggttccctggccccagggtcgagccagttcgccccccgtctctactgtatcgataggaatctctcgcacataatatacgccgtgtccgcggcggtcacagaagtcaattcagggagaactggtctggacctgtctagtgacatggtgactcgactcttgagggcgggttgtagttggtgctgccactgttatagatgcgcccaatccactccagtcccttcccggcggactgccgcagccactccaataataactactgatgtaaccaccagagacattgcaggtgaggacagggtctcgaaggcttcacccgtcctgggcccgactcctgcagctgcactcggacacgacccatctgggaggtgccaccaggaggaggaagaaccacaggtgtttcatgttcttgtgcaggaggccatgagtctcagaaagtatccccaaacccaactatcgtgtgctaaatcgagcaccggtcgtgtatatactgtctgatggcgcgagggaggcgatacg

SEQ ID NO: 791460 - DNA, 659 bp, Homo sapiens
  misc_feature: 31228.44.86.H09.1.pb.heavy.1.raw 31228
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgcccccagtataatggatgtcaccaatccactccattcccctccctgggggctgccggatccagccccaagaatgatcagaactgatggaaactccagagacagtgcagatgagagacagggttcccgaaggcctcaccagtcctgggccccgactcctgcagctgcacctgggacaggacccatctgggagctgccaccagcaggaggaaaaaccacaggtgcttcatgttcttgcacaggaaggtccttgactctcagaaagcatccccaaacccaagtctatagcactaaaatcgagcaccggtcgtgtaatatactgtctgatggcgcgaagggaggcgatacg

SEQ ID NO: 791461 - DNA, 693 bp, Homo sapiens
  misc_feature: 31238.44.55.E11.1.pb.heavy.1.raw 31238
cgtatcgcctccctcgcgcatcagacagtatatacacgaccggtgctcgatttagcactcgcacgttgggtttgggagaggagcccagcactgggattccgaggtgtttccattcggtgatcagcactgaacacagaggactcaccatggagttttggctgagctgggttctccttgttggacttttaaaaggtgtccagtgtgaggtgcggctgatgagtctggaggaggcttagtccagcctggggggtccagagactctcctgtgcagcctctgggctcaccgtcagcagcaactacatgagttgggtccgccaggctccaggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaaggcccatcggtcttccccctggcaccctcctccaagagcacctctggggcacagcggccctgggctgcctggtcaaggactacttcctatatactgtctgagcgggctggcaggcgcatag

SEQ ID NO: 791462 - DNA, 673 bp, Homo sapiens
  misc_feature: 31239.44.35.D02.1.pb.heavy.1.raw 31239
cgtatcgcctccctcgcgccatcagacagtatatacacgaccggtgctcgatttagcacacgatagttgggtttgggatactttctgagactcatgggcctcctgcacaagaacatgaaacacctgtggttcttcctcctcctggtggcacctccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattggcgcatctataacagtggcagcaccaactacaaccccgccctcaagagtcgagtcaccatgtcactagacagtccaagaaccagttctccctgaaattgacttctgtgaccgccgcgacacggccgtatattattgtgcgagagattcctatcgatacagtagagacgggggggcgaactggctcgacccctggggccagggaaccctggtcaccgtctcctcagcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 791463 - DNA, 650 bp, Homo sapiens
  misc_feature: 31243.44.86.H09.1.pb.heavy.1.raw 31243
cgtatcgcctccctcgcgccatcagacagtatatacacgaccggtgctcgatttagtgctatagacttgggttttggggatgcttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctgagtttccatcagttctgatcattcttgggctggatccggcagcccccagggaggggaatggagtggattggtgacatccattatactggggcgacgtactactctccgtcctcaagagtcgtctcaccatttcgagggacacgtccatgaaccgcttctccctgaaactgacctccgtgaccgccgcggacacggccgtttattttctgtgcgagcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcggctggcaaggcgcatag

SEQ ID NO: 791464 - DNA, 680 bp, Homo sapiens
  misc_feature: 31246.44.6.A06.1.pb.heavy.1.raw 31246
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacctggtcctcggtgaccctttcctgcacggcctctggaagtataccagttccactacttataccatcaactgggtgcgccaggccctggacaaggcttgagtggatgggtggaatcatccctctttttggctcactcacctacgcacgagacttccggggcagaattacgattaccgcggacaagtccacagacacagtctccatgacaatgagttctttgaaaatccgacgacacgccgtctactactgtgcgagaaggtccgtacgcccagctcgcatggagcctttgagatctgggggcaggggaaccctggtcattgtcacctcaagcttccaccaaagggcccatcggtcttccccctggcgccctgctccaggagggcacctctgggggcacagcggccctgggcctgcctggtcaaggactacttcactatatactgtctgagcgggctggcaaggcgcatag

SEQ ID NO: 791465 - DNA, 707 bp, Homo sapiens
  misc_feature: 31285.UNK.UNK.UNK.pb.heavy.1.raw 31285
ctatgcgccttgccagcccgctcagacagtatataggaagtagtccttgaccaggcagcccagggccgctgtgctctcggaggtgctcctggagcagggcgccagggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggttgaatccagaggctgcacaggagagtctcagggacccccctactggggccacgcctcccccagactccacgaattgcacctgacacatgacacctcttaagagggcaacgaggaaaaacccagctcagcccaaactccatggtgagtcctctgtgttcagtgatgatcaccgagtggaaacaccggcgacttccagtgctgggctcgtctcccaggcccaaacccttcgatcgcgcgtctaaatcgagcaccggtcgtgtatatactgtctgatggcgcgagggaggcgatacg

SEQ ID NO: 791466 - DNA, 709 bp, Homo sapiens
  misc_feature: 31290.44.55.E11.1.pb.heavy.1.raw 31290
cgtatcgcctccctcgcgccatcagacagtatatacacgaccggtgctcgatttagcactcgcacgttgggtttgggggggagaggagcccagcactgggattccgaggtggtttccattcggtgatcagcactgaacacagaggactcaccatggagtttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtggtttctcagtcatttattactggtgatttcacatactacgcagactccgtgaagggccgattcaccatctccagggacaattccaggaacacggtttatcttcaaatgaacaacctgagaggcgacgacaccggccgtctattactgtgcgagacaagtcggcgctcggagtggttattattcgtttgacttctggggccagggaaccctggtcaccgtcgcctccgcctccaccaagggcccatcggtcttccccctggcagcctcctccaagagcacctctggggcacagcggccctgggctgcctggtcaaggactacttcctatatactgtctgagcgggctggcaaggcgcatag

SEQ ID NO: 791467 - DNA, 607 bp, Homo sapiens
  misc_feature: 31295.UNK.UNK.UNK.pb.heavy.1.raw 31295
cccgacacgcttgctagggacttggagctaaggacgacatattgcctttaggacagtccgaaggtgacgccttagcctaccactgaacgtttaggcgccagattgcgtctggatgacctaactcgcagctatcgatgatctactgcacgctcaaccaaccaggtcttgatgcgcgcgataggactgacgggatcgcttacagacatttaactcgctagttaacttaattgagatcctaggggatgggataggaaatagaatccaccctttcaccccccacatagcctgcttggggtgttgagttttacttttatttcgtgttggaatgagttgaacttcgggaagtggagtaatggtttgtctacttccctaacgcaaagtactagttttacgagtggcgttgcaagccatagccagtcacaggtaataaacaaattcaacgtggcgtaaagattggcccgcttgctgtgggcatgcaagctgggttgcagcattgtgcatgctagacgacaatatgaatctgcgggacccctagtggccagatggccgctagcgggttccgcagcttttgacctggaccagggtgcatagcctgcccgccttcctc

SEQ ID NO: 791468 - DNA, 701 bp, Homo sapiens
  misc_feature: 31298.44.36.D03.1.pb.heavy.1.raw 31298
ctatgcgccttgccaggcccgctcagaccagtatataggaagtagtccttgaccaggcagcccagggcccgctgtgctctcggaggtgctcctggagcagggcgccagggggaagacgatgggcccttgcggaggctgaggagacggtgaccagggtccctggccccagtggacagttcctgatataacacaacacaataatacatgcccgcctgtcctcggttttcaggttagtcatcgcagaatcaatgagttcttgaagtcatctcttgagagggtgatctggctttcacagacgcgccgcgtactctgtgataagctgcaactttgtttttactgcggcaagccactccagccccttccctggagcctggcggacccagtccatatagtggtcactgatggtgaatccagaggcgacacaggagagtctcaggggacctccaggctggaccaagtctccccccggactccaccaactgcacttcactctggacaccttgtaaaataacaacaggaaaacccagctcagcccgaactccatggtgagtcctctgtgttcagtgctgatcaccaaatgaaaacacctgggaattctggggctggctccggctctcagagctccccaagagagatcgtgacgcagctaaatcgagcaccggtcgtgtatatactgtctgatggcgcgagggggcgatacg

SEQ ID NO: 791469 - DNA, 709 bp, Homo sapiens
  misc_feature: 31300.44.56.F01.1.pb.heavy.1.raw 31300
cgtatcgcctccctcgcgccatcagacagtatatacacgaccggtgctcgatttagcagacgtctgaacacacaaagggggctctgggagaggagccccagccgtgagattcccaggagtttccacttggtgatcagcactgagcacagaccaccaaccatggagtttgggctaatcttgatttccttgtagtttttagaaggtgtccagtgcgaggggcgactggcggagtcgggggggggcttggcacagccagggcggtctctgagactctcctgtgtgtctcaggattcagtcttagtgattatcacttggcctgggtccgtcaggctccagggaaggggcttgagtggatcactttcgtcagaatgaaacgttatggtggaagtaaagagtacgccgcgtctgtgaaagggaagattcaccgtctcaagggatgactccaacagtgttggccatttacaaatgagcaacctgagaccccgacgacacaggcgtctatactgcgccaggcgatcctgggacgtcgatgcatttgatatttggggccaggggacaatggtcaccgtctcttcagcttccaccaagggcccatcggtcttccccctggcgccctgctccaggagcacctctgggggcacgcggccctgggctgcctggtcaaggactacttcctatatactgtctgagcgggctggcaaggcgctag

SEQ ID NO: 791470 - DNA, 607 bp, Homo sapiens
  misc_feature: 31337.UNK.UNK.UNK.pb.heavy.1.raw 31337
gaaggctgggcaggctatgcaccctggtccaggtcaaaagctgcggaacccgctagcggcatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaagtaaactcaacaccccaagcaggctatgtggggggggtgatagggtggattctatttcctatcccatccctaggatctcaattaagttactagcgagttaaatgtctgtagcgatcccgtcagtcctatcgcgcgcatcaagacctggttggtgagcggccagtagatcatcgaaaagctgcgagttaggtcatcccagaaccgcatctggcgcctaaacgttcagtggtagctaaggcgtcaccttcgactgtctaaaaggcaatatgtcgtccttaggctccaagtcctagcaagcgtgtcgggt

SEQ ID NO: 791471 - DNA, 691 bp, Homo sapiens
  misc_feature: 31362.UNK.UNK.UNK.pb.heavy.1.raw 31362
ctatgcgccttgccaggcccgctcagacagtatataggaagtagtccttgaccaggcagccccaggggcgtgtgccccagaggtgctcctggagcagggcgccagggggaagacaatgggcccttggtgaagctgaggtgacaatgaccagggttccctgcccccagattcaaaggctccatgcgagctggggtacggaacctctcgccacagtagtagacggcgtggtcgtcggatttcaaagaactcattgtcatggagactgtgtctgtggacttgtccgccgtaatcgtaattctgcccccggaagtctcgtgcgtaggtgagtgagccaaaaagaggggatgattccaccatccactcaagcccttgtccaggggcctgcgcacccagttgatgggtataagtagtggaactggtagtacttccagaggccgtgcaggaaagggtcaccgagaccaaggttgcggcattctagtcccagactgcaccagttgcaccaggactggacacctgttgctgctgccaccacaaagaggaacctccaggtccatccatggtgatgagctgtgctcccaggggcttctttagaggaggaatgtggttttatgtgatgctcccccctgatagagctactaaatcgagcaccggtctggtatatactgtctgatggcgcgagggaggcgatacg

SEQ ID NO: 791472 - DNA, 714 bp, Homo sapiens
  misc_feature: 31412.44.55.E11.1.pb.heavy.1.raw 31412
cgtatcgcctccctcgcgccatcagacagtatatacacgaccggtgctcgatttagcactcgcacgtggttttggggagaggagcccagcactgggatccggaggtgtttccattcggtgatcagcactgaacacagagggactcaccatggagttttggctgagctgggtttctccttgttggacttttaaaaaggtggtccagtgttgggtggcgctggatgagtctggaggaggcttagtccagcctggggggtcccagagactctcctgtggcagcctctgggctcacccgtcgagcagcaactacatgagttgggtccgccaggctccaggggaagggctggagtgggggtctcagtcatttatactggtgatttcaccatactacgcagactccgtgaagggccgattcaccatctccagggacaattccaggaacacggtttatcttcaaatgaacaacctgagaggcgacgacacggccgtctattactgtgcgagacaagtcgggcgctcggagtggttattattcgtttgacttctggggccagggaaaccctggtcaccgtcgcctccgcctccaccaagggccatcggtcttccccctggcaccctcctccaagagcacctctgggggcacagcggccctgggctgcctggtcaaggactacttcctatatactgtctgagcgggcctggcaaggcgcatag

SEQ ID NO: 791473 - DNA, 696 bp, Homo sapiens
  misc_feature: 31429.UNK.UNK.UNK.pb.heavy.1.raw 31429
cgtatcgcctccctgcgccatcagacagtatatacagcgaccggtgctcgatttagtagctctatcagggggagcatcacaataacaaccacattcctcctctaaagaagcccctgggagcacagctcatcaccatggactggacctggaggttcctctttgtggtggcagcagcaacaggtgtccagtccctggtgcaactggtgcagtctgggactaagaatgccgcaaccttggtcctcggtgaccctttcctgcacggcctctggaagtactaccagttccactacttataccatcaactgggtgcgccagggcccctggacaagggcttgagtggatgggttggaatcatccctcttttttggctcactcacctacgcacgagacttccgggcagaattacgattaccggcggacaagtccacagacacagtctccatgacaatgagttctttgaaatccgacgacacggccgtctactactgtgcgagaggtccgtaccccagctcgcatgggagcctttgagatctgggggcaggaaccctgtcattgtcacctcagctccaccaagggcccatcggtcttccctggccgccctgctccaggagcacctctgggggcacagcggccctgggctgcctggtcaaggactacttcctatatactgtctgagcgggctggcaaggcgcatag

SEQ ID NO: 791474 - DNA, 714 bp, Homo sapiens
  misc_feature: 31474.44.85.H08.1.pb.heavy.1.raw 31474
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtctggggaggcgtgtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaaggccgattcaccatctccagagacaattccaagacacgctgtatctgcaaatgaacagcctgagagccgaggacacggctgtgtattactgtgcgaggacatattgtagtactaccacctgctggactactactacggtatggacgtctggggccaagggaccacggtcaccgtctcctcagcctccaccaagggcccatcggtcttccccctggcaccctcctccaagagcactctgggggcacagcggccctggctgcctggtcaaggactacttcctatatactgtctgagcgggctggcaaggcgcatag

SEQ ID NO: 791475 - DNA, 692 bp, Homo sapiens
  misc_feature: 31493.44.85.H08.1.pb.heavy.1.raw 31493
cgtatcgcctccctcgcgccatcagacagtatatacacgaccggtgctcgatttagtatcactcagtcgcgggggggagaggagcccagcactagaagtcggcgtgtttccattcggtgatcagcactgaacacagaggactcaccatggagtttgggctgagctgggtttcctcgttgctctttagaggtgtccagtgtcagggcagctgggagtctgggaggcgtgtccagcctgggaggtcctgagactctcctgtgcagcgtctggattcaccttcagtacctatggcatgcactgggtccgccaggctccagcaaagggctgagtgggtggcacttatatggtatgatggaagtaataaatactatgcagactccgtgaagggccgattcaccatctccagagacaattcaagaacacgctgtatctgcaaatgaacagcctgagagccgaggacacgctggtattactgtgcgagacatattgtagtactaccacctgctgggactactactacggtatggacgtctgggccaagggacacggtcaccgtctcctcagcctccaccaagggccatcggtcttccccctggcacctcctccaagagcacctctgggggcacagcggcctgggctgcctggtcaagactacttccatatactgtctgagcgggggccaaggcgcatag

SEQ ID NO: 791476 - DNA, 672 bp, Homo sapiens
  misc_feature: 31512.UNK.UNK.UNK.pb.heavy.1.raw 31512
ctatgcgccttgccagcccgctcagacagtatataggaagtaatccttgaccaggcagcccagggccgctgtgcccccagaggtgctcctggagcagggcgccagggggaagaccgatgggcccttggtggaagctgaggtgacaatgaccagggttccctgccccagatctcaaaggctccatgcgagctggggtacggacctctcgcacagtagtagacggccgtgtcgtcggatttcaaagaactcattgtcatggagactgtgtctgtggacttgtccgcggtaatcgtattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgcgcaccacaagaggaacctccaggtccagtccatggtgatgaagctgtgctcccaggggcttctttagaggaggaatgtggttgtcagtagatctaaatcgagccaccggtcgtgtatatactgtctgatggcgcgagggaggcgatacg

SEQ ID NO: 791477 - DNA, 701 bp, Homo sapiens
  misc_feature: 31592.44.55.E11.1.pb.heavy.1.raw 31592
cgtatcgcctcctcgcgccatcagacagtatatacacgaccggtgctcgatttagcactcgcacgttggttttggggagaggagcccagcactgggattccgaggtgtttccattccggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggaaggggctggagtgggtctcagtcatttatactggtgatttcacatactacgcagactccgtgaagggccgattcaccatctccaggacaattccaggaacacggtttatcttcaatgaacaacctgagaggcgacgacacggccgtctattactgtgcgagacaagtcggccgctcggagtggttattattcgtttgacttctgggccagggaaccctggtcaccgtcgcctccgcctccaccaagggcccatcggtcttccccctggcacccctcctccaagagcacctctgggggcacagcgccctgggctgcctggtcaaggactacttcctatatactgtctgagcgcggctggcaaggcgcatag

SEQ ID NO: 791478 - DNA, 702 bp, Homo sapiens
  misc_feature: 31593.UNK.UNK.UNK.pb.heavy.1.raw 31593
cgtatcgcctccctcgcgcgcatcagacagtatacacgacgtgctcgatttagctgcgtcacgatctctcttggagctctgagagcggaggcccagccccagaattccaggtgtttttcatttggtgatcagcactgaaacaagaggacttcaccatggagttcgggctgagcctgggttttccttgttgtttatgtttacaacaaggctgtccagagtgaagtgcagttggtggagtccgggggagatggtccagcctggagggtcctgaagactctcctgtggtcgcctctggattcacatcagtgaccactatatggactggggtccgccagctccagggaaggggctggagtggcttgcccgcaagtaaaacaaagttgccagcttaatcacagagtacgcgcgtctgtgaaagccagattcaacctctcagagatgactttcaagaactcattgattctgcgaatgactaacctgaaaaccgaggacacgggcatgtattattgtgttgtgtttatatcaggaacgtccactggggcccagggaaccctggtcaccgtctcctcagcctccaccaagggcccatcggtcttcccctggcgccctgctccaggagcacctccgagagcacagcggcctgggctgcctggtcaaggactacttcctatatactgtctgagcggctggcaaggcgcatag

SEQ ID NO: 791479 - DNA, 694 bp, Homo sapiens
  misc_feature: 31597.UNK.UNK.UNK.pb.heavy.1.raw 31597
ctatgcgccttgccagcccgctcagacagtatataggaagtagtccttgaccaggcagcccagggcccgcttgtgctctcggaggtgctcctggagcagggcgccaggggaagaccgatgggccccttggtggaggccgaggagacggtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagactttgatttcctccatgaaatgacacacctgccaccactccagcccctcgcctggagcctggcggaccactgcatatttccaattattcgaaggtgaatccagaggctgcacaggagagtctcagggaacccccctactgggccacgcctcccccagactcccacgaattgcacctgacacatgacacctcttaagagggcaacgaggaaaaccccagctcagcccaaactccatggtgagtcctctgtgttcagtgatgatcaccgagtggaaacaccggcgacttcctctttcccccaaacccttcgatcgcgtctaaatcgagcaccggttcgtgtatatactgtctgatggcgcgagggaggcgatacg

SEQ ID NO: 791480 - DNA, 649 bp, Homo sapiens
  misc_feature: 31600.44.57.F02.1.pb.heavy.1.raw 31600
ctatgcgccttgccagcccgctcagacagtatataggaagtagtccttgaccaggcagcccagggccgctgtgccccgagaggtgctcctggagcagggcgccaggggaagacgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatgacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactctgcagctgcacctgggacaggacccatctgggagctgccaccagcaggaggaaaaaccacaggtgcttcatgttcttgcacaggaggtccttgactctcagaaagcatcccaacccaactatatcgagctaaatcgagcaccggtcgtgtatatactgtctgatggcgcgagggaggcgatacg

SEQ ID NO: 791481 - DNA, 600 bp, Homo sapiens
  misc_feature: 31624.44.78.H01.1.pb.heavy.1.raw 31624
ctatgcgccttgccagcccgctcagacagtatataggaagtagtccttgaccaggcagcccagggccgctgtgctctcggaggtgctcctggagccagggcgccagggggaagaccgatgggcccttggtggaggctgaggagacggtgaccagggttccctggccccacaagtcaagccaggtgctggtggctctcgcacagaaatacacgggccgtgtcctcagatctcaggctgctcagttccatgtagactgtacctggggaggtgctcctggtcatactaactctgccttggaacttctgggcaaagcccgtgttgccactatagggccttcatccatcccatccactccagcccttgtccagcggcctgtcgcacccaagttaatatcataattgatgaacgtgtatccagaagccgtgcaggagactgtcactgaggcccccaggcttcttcacctcagccccagactgcaccagctgtacctgggagtgggaccgtccagtcttcctcttcccccccaaacccaaactactcacactaaatcgagcaccggtcgtgtatatactgtctgatggcgcggagggaggcgatacg

SEQ ID NO: 791482 - DNA, 698 bp, Homo sapiens
  misc_feature: 31651.44.27.C05.1.pb.heavy.1.raw 31651
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattcgacgcctgggccagggaccctggtcaccgtctcctcggcctccaccaagggcccatcggtcttcccctggcgccctgctccaggagcacctccgagagcacagcggcctgggctgcctggtcaaggactacttcctatatactgtctgagcgggctgcaggcgcatag

SEQ ID NO: 791483 - DNA, 736 bp, Homo sapiens
  misc_feature: 31654.UNK.UNK.UNK.pb.heavy.1.raw 31654
cgtatcgcctcctcgccgcccatcagacagtatataacccgaccgtgctcggatttagagtgagctcgttggttttggggagctcctgggagaggagcccagcaccagaagtcggcgtgtttccagtcggtgaatcagcaccgaaccacagaggactcaccatggagtttgggctgaccctgggttttcctcgttgctcttttaagaggtgtccagtgtcaggtgaagctggtggagtctgggggagcgtggtccagcctgggaaggtccctgagactctcctgtgtagcgtctggattcaccttcaacagacatggcatgcactgggtccgccaggctccaggcaagggactcggagtggtggcacttatatgggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatgcgacgcctggggccaagggaccacggtcgccgtccctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791484 - DNA, 707 bp, Homo sapiens
  misc_feature: 31675.44.36.D03.1.pb.heavy.1.raw 31675
ctatgcgccttgccagcccgctcagacagtatataggagtagtcctgaccaggcagccagggccgctgtgctctcgggaggtgccctggagcagggcgccaggggaagaccgatgggccccttggtggaggctgaggagacggtgaccagggttccctggcccagtggacagttcctgatataaacacaacacaataatacatgccgtgtcctcggttttcaggttagtcattcgcagaatcaatgagttcttgaagtcatctctttgagagggtgaaatctggcttcaacaggaccgcggcgtactctgtgataaagctggcaactttgtttttactgcggccaaggccactccagcccttccctggagccctggcggacccagtccatatagtggtcactgattggtgaatccagaggcgacacaggagagtctcagggaccctccaggctggaccaagtcttcccccggactccaccaactgcacttcactctggacccttgtaaaataacaacaaggaaaaacccagctcagccgaaactccatggtggtcctctgtgttcagtgctgaatcgcaaatgaaaaacacctgggaattctggggctggggctccgctctcagagctccccaagagagatcgtgacgcagctaatcgagcaccggtcgtgtatatactgtctgatggcgcgaagggaggcgatacg

SEQ ID NO: 791485 - DNA, 645 bp, Homo sapiens
  misc_feature: 31698.44.23.C01.1.pb.heavy.1.raw 31698
ctatgcgccttgccagcccgctcagacagtatataggaagtagtccttgaccaggcagcccagggccgctgtgcccccagaggtgctcctggagcagggcgccaggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatatgtctgatggcgcgagggaggcgatacg

SEQ ID NO: 791486 - DNA, 636 bp, Homo sapiens
  misc_feature: 31722.44.23.C01.1.pb.heavy.1.raw 31722
cgtatcgcctccctcgcgccatcagacagtatatacacgaccggtgctcgatttagtacacgtgattagggattggggcagggtgaaaacacctgtgggttttttcctcctgctggtggcagctcccagatgggtcctgtcccaggtgcagctgcaggagtcgggcccaggactggtgaggcctttcgggaaaccctgtctctcatctgcactgtctcttggagttttccatcagtttctgatcattcttggggctggatccggcagcccccagggaggggaatggaaagtggattggtgacatccattatactggggcgacgtactactctccgtccctcaagagtcgtctcaccattttcgagggacacgtccatgaaccggcttctccctgaaaactgacctccgtgaccgccgcggacacggccgtttatttcttgtgcgaaggcgagactggtctttcatctatggggccgtggcaccctggtcactgtctcctcagcttccaccaaggggcccatcggtcttccccctggcgccctgctccaggagcacctctggggcacagcggccctgggctgcctggtcaaggactacttcctatatactgtctgagcgggctggcaaggcgcatag

SEQ ID NO: 791487 - DNA, 700 bp, Homo sapiens
  misc_feature: 31754.44.36.D03.1.pb.heavy.1.raw 31754
cgtatcgcctccctcgcgccatcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggagacttggtccagcctggagggtccctgagactctcctgtgtcgcctctggattcaccatcagtgaccactatatggactgggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791488 - DNA, 661 bp, Homo sapiens
  misc_feature: 31759.44.74.G08.1.pb.heavy.1.raw 31759
acagtatataggaagtagtccttgaccaggcagccagggccgctgtgcccccagaggtgctcctggagcagggcgccaggggaagaccgatggcccttggtggaagtgaggtgacaatgaccagggttccctgccccagatctcaaaggctccatgcgagctggggtacggacctctcgcacagtagtagacggcgtgtcgtcggatttcaaagaactcattgtcatggagactgtgtctgtggacttgtccgcggtaatcgtaattctgccccggaagtctcgtgcgtaggtgagtgagccaaaaagagggatgattccaccatccactcaagcccttgtccaggggcctggcgcacccagttgatggtataagtagtggaaactggtagtacttccagaggccgtgcaggaaagggtcaccgaggaccaaggttgcggcattctagtccagactgcaccagttgcaccagggactggacacctgttgctgctgccaccacaaagaggaacctccaggtccagtccatggtgatgagctgtgctcccaggggcttctttagaggaggaatgtggtgttatgtgatgctccccctgatagagctactaaatcgagcaccggtcgtgtatatactgtctgatggcgcgagggaggcgatacg

SEQ ID NO: 791489 - DNA, 598 bp, Homo sapiens
  misc_feature: 31810.UNK.UNK.UNK.pb.heavy.1.raw 31810
aggctgggcaggctatgcaccctgtccaggtcaaaagctgcggaaccgctagcgccatctggccactagggtcccgcagattcatattgtcgtctagcatgcacaatgctgcaacccagcttgcaatgcccacagcaagcggccaatctttacgcacgttgaattgtttattacctgtgactggctatggcttgcaacgccactcgtaaaactagtactttgcggttaggggaagtagacaaacccattactccacttccggaagttcaactcattccaacacgaaataaaaagtaaactcaacaccccaagcaggctatgtggggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtcctagcaagcgtgtcggg

SEQ ID NO: 791490 - DNA, 598 bp, Homo sapiens
  misc_feature: 31868.UNK.UNK.UNK.pb.heavy.1.raw 31868
ccgacacgccttgctagggacttggagctaaggacgacatattgccttagacagtcgaaggtgacgccttagctaccactgaacgtttaggcgccagatgcgtctgggatgacctaactcgcagcttatcgatgatctactgcacgctcaaccaaccaggtcttgatgcgcgcgatagactgacgggatcgctacagacatttaactcgctagtaacttattgagatcctaggggatgggataggaaaatagaatccaccctatcaccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtggcattgcaagctggtttgcagcattgtgcatgctagacgacaatatgaatctgcgggaccctagtggccaagatggccgctagcgggttccgcagcttttgactggaccagggtgcatagcctgcccagccttc

SEQ ID NO: 791491 - DNA, 719 bp, Homo sapiens
  misc_feature: 31874.44.39.D06.1.pb.heavy.1.raw 31874
cgtatcgcctccctcgcgccatcagacagtatatacacgaccggtgctcgatttagtgacatctcgcagttctttggggagagacgagccagcactggaagtcgccggtgtttccattcggtgatcatcactgaacacagaggactcaccatggagtttgggctgagctgggtttttcctcgttgctcttttaagaggtgtccagtgtcaggagcacttggtggagtctgggggaggcgtggtccagcccgggaggtccctgagactctcctgtgtagcctctgggttctcattcgactagatttggtttgcactgggtccgccaggctccaggcaaggggccggagtgggtggcagtcatctcgacgatggaagtgagaagtattactcagactccgtgaagggcgatcaccatctccgagacaattccaagaatatgctgtatttgcaaatgaacagcgtgagagttgacgacacgtctgtttattactgtgcgagggggactccaaggaaacggttcggggaatcataaactactactatttgatggatgtctggggcaggggacgtcggtcaccgtctcctcagcttccaccaagggccatcggtcttcccctggcgccctggctccaggagcacctctgggggcacagcggccctgggctgcctggtcaagactacttcctatatactgtctgagcgggctggcaggcgcatag

SEQ ID NO: 791492 - DNA, 619 bp, Homo sapiens
  misc_feature: 31885.44.12.B01.1.pb.heavy.1.raw 31885
cgtatcgcctcctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcagagtcggcccaggactggtgaagccttcggagaccctgtccctcacctgcactgtctctggtggctccatcagcagtagtagttactactggggctggatccgccagcccccagggaaggggctggagtggattgggagtatctattatagtggagcacctactacaacccgtccctcaagagtcgagtcaccatatcagtagacacgtccaagaaccagttctcctgaagctgagctctgtgaccgccgcggacacggcgtgtattactgtgcgagagtagggcagttcgtcaccaactactttgaccactgggccagggaaccctggtcaccgtctcctcagcctccacaagggcccatcggtcttcccctggcaccctcctccaagagcacctctggggcacagcggcctggctgcctggtcaaggactacttccta

SEQ ID NO: 791493 - DNA, 706 bp, Homo sapiens
  misc_feature: 31931.UNK.UNK.UNK.pb.heavy.1.raw 31931
ctatgcgccttgccagcccgctcagacagtatataggaagtagtccttgaccaggcagcccagggccgctgtgctctcggaggtgctcctggagcagggcgccagggggaagaccgatggcccttggtggaggccgaggagacggtgaccagggttccctggccccaggcgtcgaatgaaccgatttggaaacagatagtctcgccacaaaatacacggccgtgtcctgaggtctcaggctgttcattttgaagagacactgtgttctcggaattgtctctggagatggtgaatcggccctcaacggaatcaccgtagacttgatttcctccatgaaatgacacactgccacccactccagccctcgcctggagcctggcggacccactgcatattccaattatcgaaggtgaatccagaggctgcacaggagagtctcagggacccccctactggggccacgcctcccccagactccacgaattgcacctggacacatgacacctcttaagagggcaacgaggaaaaccccagctcagcccaactccatggtgagtcctctgtgttcagtgatgatcaccgagtggaaaacacccggcgacttccagtgctgggctcgtctcccaggccccaaacccttcgatcgcgtctaaatcgagtaccggtcgtgtatatactgtctgatggcgccgagggaggcgatacg

SEQ ID NO: 791494 - DNA, 724 bp, Homo sapiens
  misc_feature: 31949.UNK.UNK.UNK.pb.heavy.1.raw 31949
cgtatcgcctccctcgcgccatcagacagtatatacaccgaccggtgctcgatttagcactcgcacgtttgggtttgggggggagaggaagccagcactgggatttccgaggtgtttccattcggtgatcagcactgaacacagaggaactcaccatggagttttttggctgagctgggttctccttgttggactttttaaaaaggtgtccagtgtgaggtgcggctgatggagtctggaggaggcttagtccagcctggggggttcccagagacttctcctgtgcagcctctgggctcaccgtcagcagcaactacatgagttgggtccgccaggctccagggaagggggctggagttgggtctcagtcatttatactggtgattttcacatactacgcagactccgtgaagggccgattcaccatctccagggacaattccaggaacacggtttatcttcaaatgaacaacctgagaggcgacgacacggccgtctattactgtgcgagaacaagtcggcgctcggagtggtttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcggggctggcaagggcgcaatag

SEQ ID NO: 791495 - DNA, 708 bp, Homo sapiens
  misc_feature: 31951.UNK.UNK.UNK.pb.heavy.1.raw 31951
cgtatcgcctccctcgcgccatcagacagtatatacacgaccggtgctccgatttagcactcgcacgttgggtttggggggagaggagcccagcactgggattccgaggtgtttccattcggctgatcagcactgaacacagaggactcaccatggagttttggctgagctgggttctcccttgttggactttaaaaggtgtcccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatatacgcagactccgtgaagggccgattcaccatctccagggacaattccaggaacacggttttatcttcaaatgaaacaacctgagaggcgacgacacggccgtctattactgtgcgagacaagtcggcgctggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791496 - DNA, 603 bp, Homo sapiens
  misc_feature: 31953.UNK.UNK.UNK.pb.heavy.1.raw 31953
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgttgagtttacttttatttcgtgttggaatgagttgaacttccggaagtggagtaatggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggcgctagcgggttccgcagcttttgacctggaccagggtgcatagcctgcccagccttc

SEQ ID NO: 791497 - DNA, 605 bp, Homo sapiens
  misc_feature: 31961.UNK.UNK.UNK.pb.heavy.1.raw 31961
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttactttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791498 - DNA, 706 bp, Homo sapiens
  misc_feature: 31973.44.55.E11.1.pb.heavy.1.raw 31973
cgtatcgcctccctcgcgccatcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacgggccgtctattactggtgcgagacaagtcggcggctcggagtggttattattcgtttgacttctggggccagggaaccctgggtcaccgtcgcctccgcctccacccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791499 - DNA, 652 bp, Homo sapiens
  misc_feature: 31980.44.86.H09.1.pb.heavy.1.raw 31980
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggccggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacagtgcttcatgttcttgcacaggaggtccttgactctcagaagcatccccaaacccaagtctatagcactaaatcgagcaccggtcgtgtatatactgtctgatggcgcgagggaggcgatacg

SEQ ID NO: 791500 - DNA, 697 bp, Homo sapiens
  misc_feature: 31990.44.55.E11.1.pb.heavy.1.raw 31990
ctatgcgccttgccagcccgctcagacagtatataggaagtagtccttgaccaggcagccagggccgctgtgccccagaggtgctcttggaggaggtgccagggggaagaccgatgggccttggtggaggcggaggcacggtgaccagggttccctggccccagaagtcaaacgaataataacactccgagcgccgacttgtctcgcacagtaatagacggccgtggtcgtcgcctctcaggtgttcatttgaagataaaccgtgttcctggaattgtccctggagatggtgaatcggccttcacggagtctgcgtagtatgtgaatcaccagtataaatgactgagacccccactccagcccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaaccagctcagccaaaactccatggtgagtctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 791501 - DNA, 719 bp, Homo sapiens
  misc_feature: 32015.44.55.E11.1.pb.heavy.1.raw 32015
cccgctcagaccagtatataggaagtagtccttgaccaggcggcccagggccgctgtgcccccagaggtgctcttggaggagggtgccaggggggaaagaccgatgggcccttggtggaggcggaggcggacggtggaccagggttccctggccccagaagtcaaacgaataaataaccactccgagcgccgacttgtctcgcacagtaatagacggccgtgtcgtcgccctctcaggttgtcatttgaagaataaaccgttgtttcctggaattgtcccctggagatggtgaattcggcccctttcacggggtctgcgtagtatgtggaaatcaccagtataaatgactgagaccccactccagcccccttccctggagcctggcgggacccaactcatgtgttgctggctgtgacggtgagcccagaggctgcccaggagagtctctggggacccccccaggctggactaagcctcctcagactccatcagccgcacctcacactggacacctttttaaaagtccaacaaggggagaacccagctcagccaaaactccaatggtgagtccctctgtgttcagtgctgatcaccgaatggaaacaacctcggaattccagtgctgggcttcctctcccccaaaacccaacgtgcgagtgctaaatcgagcaccggtcgtgtaataactggtctgatggcgcgggagggaggcgatacg

SEQ ID NO: 791502 - DNA, 703 bp, Homo sapiens
  misc_feature: 32018.44.27.C05.1.pb.heavy.1.raw 32018
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcacgtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctccttggcctccaccaagggccatcggtcttccccctggcgccctgctccaggagcacctccgaggcacagcggccctgggctgcctggtcaaggactacttcctatatactgtctgagcgggctggcaaggcgcatag

SEQ ID NO: 791503 - DNA, 672 bp, Homo sapiens
  misc_feature: 32055.44.71.G05.1.pb.heavy.1.raw 32055
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccggggtccctttgcccagacgtccatgtagtagtaatacttgtattgttgtaacttctgcgaccctctggcacagtaataaagggccgtgtcgtccactcgcaggctcttcatctgcagaaacaccgtattcttggaattgtccctggagacgatgaagcggccttcacggagtctgcgacatttgtggcactaccaccagtaatggatgagacccactccagccccttccctggggcctgacggacccagatcatggcataggtattaaaggcgaatccagaggctgcacaggagagtgtcagggacccccccggctgtaccaagcctccccccgactccaacagctgcacttcacactggacaccttttaaaacagccacaagaaaaagccagctcagcccaaactccatggtgagttctctctgttcagtccccagggctgggctcctctctcttgcgacgacactaaatcgagcaccggtcgtgtatatactgtctgatggcgcgagggaggcgatacg

SEQ ID NO: 791504 - DNA, 657 bp, Homo sapiens
  misc_feature: 32078.44.70.G04.1.pb.heavy.1.raw 32078
ctatcgcctccctcggcgccatcagacagtatatacacgaccggtgctcgatttagtgtagtgtgaagggaaagggggactcctgtgccccaccatggacacactttgctccacgctcctgctgctgaccatcccttcatggggcctgtcccagatcaaccgtgaaagagtctggccctacattggtgaaaaccacaacagaccctcacgctgacctgcaccgtctcaggcttctcactcgtcactcctggagagggcgttgtctgggtgcggcagccccccggaaaaggccctggagtggatcgcactcaccttattggaatgacgatatacgatatagtccttctctgacgaccagactcacgctcacgaaggacacgtccaaaaccagggtggtccttacattgaccaacgtggaccctgtggacacaggcacatatttttctgtgccccacttcatgaccacaatgaccacgggcttcttcgaaccctggggccagggaatccaggtcaccgtctcatcagcctccaccaagggcccatcggtcttcccctggcgcctgctccaggagcacctccgagagcacagcgggccctgggctgcctgtcaaggactacttcctatatactgtctgagcgggctggcaaggcgcatag

SEQ ID NO: 791505 - DNA, 660 bp, Homo sapiens
  misc_feature: 32086.UNK.UNK.UNK.pb.heavy.1.raw 32086
cgtatcgcctccctcgcgccatcagtctatactatcacgacccggtgctcggatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggggcccaggactggtgaggccttcgggaaccctgtctctcatctgcactgtctctggagtttccatcagttctgatcgattcttggggctggatccggcagccccccagggaggggaatggaggtggattggtgacatccattatactggggcgacgtactaaactctccgtcctcaagagtcgtctcaccatttcgaggacacgtccatgaaccgcttctccctgaaactgacctccgtgaccgccgcggacacggccgtttattttctgtgcgaggcgagactggtctttcaatctatgggccgtggcaccctggtcactggtctcctcagcttccaccaaggcccatcggtcttcccccctggcgccctgctcaggagcacctctggggcacagcgggccctgggctgcctggtcaaggactacttcctatatactgtctgagcggctggcaaggcgcatag

SEQ ID NO: 791506 - DNA, 712 bp, Homo sapiens
  misc_feature: 32092.44.62.F07.1.pb.heavy.1.raw 32092
cgtatcgcctccctcgcgccatcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcgcgcctgggaggtccctgaccctctcctgtgcggcctctggattcacctttagtgcctatggcatgacctggggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791507 - DNA, 658 bp, Homo sapiens
  misc_feature: 32094.44.19.B08.1.pb.heavy.1.raw 32094
cgtatcgcctccctcgcgccatcagacagcagtatatacacgaccggtgctcgattttagtgagtcagtaagggggactctgtgccccaccatggacacactttggctccacgctccctgctgctgaccatcccttcatggggcctgtcccagatcaccgtgaaagagtctgggccctacattggtgaaacccacacagaccctccacgctgacctgcaccgtctcaggcttctcactcgtcactcctggagagggcgttgtctgggtgcggccaggccccccggaaaggccctggagtggatcgcactcacttattgaatgacgatatacgatatagtccttctctgacgaccagactcacgctcaccgaaggacacgtccaaaaaccaggtggtgccttacattgaccaacgtgaccctgtggacacaggccacatatttctgtgcccacttcatggaccacaaatgaccacgggcttcttcgaaccctggggccagggaatccaggtcaccgtctcatcagcctccaccaagggcccatcggtcttccccctggcgccctgctccagagcacctccgagagcacagcggccctgggctgcctggtcaaggactacttcctatatactgtctgagcggcgctggcaaggcgcatag

SEQ ID NO: 791508 - DNA, 685 bp, Homo sapiens
  misc_feature: 32110.44.45.E01.1.pb.heavy.1.raw 32110
ctatgcgccttgccagcccgctcagacagtatataggaagtagtccttgaccaggcagcccagggccgctgtgctctcggaggtggctcctggagcagggcgccaggggaagaccgatgggcccttggtggaggctgaggagacggtgaccagggctccctggccccagtagaacgatgggctcgtacaataatagagagccgagtcctcggctctcaaattgttcattgtagatacacggtgttcttggaattgtctctggagacggagaatcggcccctcacggagtttccatagtattctttacttccatcagaccagatgactgccaccccactccagccccttgcctggagcctggcggacccagtgcatggcagagtcactgaaactgagtccggacgcaacacagggagtctcagggacgtcccaggctggaccacgcctcccccagactccaccagctgaacctgacactggaacacctcttaaaagagcaacgaggaaaacccagctcagcccaaactccatggtgagtcctctgtgttcagtgctgatcaccgaatggaaacaccgccgacttctagtgctggggctcctctcccagcccctttcccttactgactcactaaatcgagcaccggtcgtgtatatactgtctgatggcggcgagggaggcgatacg

SEQ ID NO: 791509 - DNA, 671 bp, Homo sapiens
  misc_feature: 32177.44.35.D02.1.pb.heavy.1.raw 32177
cgtatcgcctccctcgcgccatcagacagtatatacacgaccggtgctcgatttagcacacgatagttgggtttgggatactttctgagactcatgggcctcctgcacaagaacatgaaaacacctgtggttcttcctcctcctgtggcacctcccagatgggtcgtgtccgaggtgcagctgcaggagtcgggcccaggacgggtgaagccttcggagaccctgtccctcacctgcaatgtctcctggtggttacatcagtagttattattggagttggctgcggcagtccgcgggaagggactggagtggattggccgcatctataacagtgcagcaccaactacaacccgcctcaagagtcgagtcacatgtcactagacaggtccaagaaccagttctccctgaaattgacttctgtgaccgccgcggacacggccgtatattattgtgcgagagattcctatcgatacagtagagacggggggcgaactggctcgatccctgggccagggaaccctggtcaccgtctcctcagcctccaccaagggcccatcggtcttccccctggcaccctcctccaagagcacctctgggggcacagcggccctgggctgctggtcaaggactacttcctatatactgtctgagcgggctggcaaggcgcatag

SEQ ID NO: 791510 - DNA, 704 bp, Homo sapiens
  misc_feature: 32198.44.62.F07.1.pb.heavy.1.raw 32198
ctatgcgccttgccagcccgctcagacgggtatataggaagtagtccttgaccaggcagcccagggccgctgtgctctcggagtgctcctggagcagggcgccagggggaagaccgatgggcccttggtgaggctgaagagacggtcaccactgtccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcgggcccttcacggagtctccgtagaaagtgacaccaccagctccgatacttgagacccactccagtcccctccctggagcccgcggacccaggtcatgccataggcactaaaggtgaatccagggcgcacaggagagggtcagggacctcccaggcgaatcaggcccccccagactccaacaactgcacttcacacacgacacctttaaaaagccacaagaaaaaggcagctcagcccaaactccatggagacttctctctgttcggtcctggtcaccaatgaagacacctgaaaatcccagggctgggctcctctctcagagctcccctttccccttatgcgactactaaatcgagcaccggtcgtgtatatactgttctgatggcgcgagggaggcgatacg

SEQ ID NO: 791511 - DNA, 693 bp, Homo sapiens
  misc_feature: 32258.44.55.E11.1.pb.heavy.1.raw 32258
tgcgccttgccagcccgctcagacagtatataggaagtagtccttgaccaggcagcccaggccgctgtgccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagccccttccctggagcctggcggacccaactcatgtagttgctgctgacggtgagccagaggctgcacaggagaagtctctgggacccaggctggactaagcctcctccagactccatcagccgcacctcacactggacaccttttaaaagtccaacaaggagaaccagcctcagccaaaaactccatggtgagtcctctgtgttcagtgctgatcacgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 791512 - DNA, 707 bp, Homo sapiens
  misc_feature: 32270.44.36.D03.1.pb.heavy.1.raw 32270
ctatgcgccttgccagcccgctcagacagtatataggaagtagtccttgaccaggcagcccagggccgctgtgctctcggaggtgctcctggagcagggcgccaggggggaagaccgatgggccttggtggaggctgaggagacggtgaccagggttccctggccccagtggacagttctgatataaacacaacacaataatacatgccgttgtcctcggtttttcaggttagtcattcgcagaatcaatgagttcttgaagtcatctcttgagagggtgaaatctgggcttcacagacgcggcgtactctgtgataaagctggcaactttgtttttactgcggccagccactccagccccttccctggagcctggcggacccagtccatatagtggtcactgatggtggaatccaggaggcgacacaggagagtctcagggacctccaggctggaccaagtctcccccggactccaccaactgcacttcactctggacacttgtaaaataacaacaaggaaaacccagctcagcccgaactccatggtgaggtcctctgtgttcagtgctgatcaccaaatgaaaacacctgggaattctggggctgggggctccgctctcagagctccccaagagagatcgtgacgcagctaaatcgagcaccggtcgtgtatatactggtctgatgggcgagggaggcgatacg

SEQ ID NO: 791513 - DNA, 729 bp, Homo sapiens
  misc_feature: 32296.44.33.C11.1.pb.heavy.1.raw 32296
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggccaagggaccacggtcgccgtctcctcagcctccaccaagggcccatccggtcttccccctggcaccctcctccaagagcacctctggggcacagcggccctgggctgcctggtcaaggactacttcctatatactgtctgagcgggctggcaaggcgcatag

SEQ ID NO: 791514 - DNA, 658 bp, Homo sapiens
  misc_feature: 32300.UNK.UNK.UNK.pb.heavy.1.raw 32300
ctgatgcgctgcagcccgctcagacaggtatataggaagtgtcctgaccaggcagcaggggcgctggctctcggaggctgctcctggcagggcgcagggggaagaccgatggccttggtggaggctgaggatgaggagacggtgaccgtggtccccttggccccagacgtcccaagcgtagtagattgagacgacctgccataggcggacccatgtctgacacagtagtagacagccgtggtcggcggcggccacagaactcactttcagggaaaactgtgtcctcgacgtgtcacggatatggtgactcgaccgttgagggacgggttgtagtaggtgttcccactataatagagactcccaatccactgcagcccctctcctggggggctggcggatccagccccagtagaaattacttctgtcgatggaggcaccagagaccgtgcacgtgagggaagcagggtctcccgataggcttcacagtcctgggtcccgactctcccgcagctgcggctgagaacaggacccatctgggagccgccaccagcaggaggaagaaccacaggtgcttccccccaaacccaacacactcgtctctaatcgagcaccggtgcgtgtatatactgtctgaggcggcgagggaggcgatacgagc

SEQ ID NO: 791515 - DNA, 733 bp, Homo sapiens
  misc_feature: 32309.UNK.UNK.UNK.pb.heavy.1.raw 32309
cgtatcgcccctccgccctcgccgcgccatcagacagtatatacacgaaccggtgctcgatttgagtatcactcagtcgcgggagctctgggagaggagcccagcactagaagtcgggcggtgtttccattcggtgatcagcactggaacacagaggactcaccatggagtttgggctgagctgggttttcctcgttgctcttttaagagggtgtccagtgtcaggtgcagctggtggagtctgggggaggcgtggtccagcctgggaggtccctgagactctcctgtgcagcgtctggattcaccttcagtacctatgcatgcactgggtccgccaggctccaggcaaggggctggagtggggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctggactactactacggtatggacgtctggggccaagggaccacggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791516 - DNA, 601 bp, Homo sapiens
  misc_feature: 32311.UNK.UNK.UNK.pb.heavy.1.raw 32311
aaggctgggcaggctatgcaccctggtccaggtcaaaagctgcggaacccgctagcggccatcttggccactagggggtcccgcagatcatattgtcgtctagcatgcacaatgctgcaaaccagcttgcaatgccccacagcaagcggcaatcttacgcccacgtgaattgtttattacctgtgactggctatggctgcaacgccactcgtaaaactagtactttgcggttaggggaagtagacaaacccattactccacttccggaagttcaatcattccaacacgaaataaaagtaaactcaaccccaagcaggctatgtggggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactggtctaaaggcaatatgtcgtccttagctccaagtccctagcaagcgtgtcgg

SEQ ID NO: 791517 - DNA, 560 bp, Homo sapiens
  misc_feature: 32360.UNK.UNK.UNK.pb.heavy.1.raw 32360
cgtatcgcctccctcgcgccatcagacagtatatacacgacggtgctcgatttagtacacgtgattaggattggggcagggtgaacacctgtgtttttctcctgctgtggcagctccagatgggtcctgtcccaggtgcagctgcaggagtcggcccaggactggtgaggccttcgggaaccctgtctctcatctgcactgtctctggagtttccatcagttctgatcattcttgggctggatccggcagcccccaggaggggaatggagtgattggtgacatccattatactggggcgacgtactactctccgtcctcaagagtcgtctcaccatttcgagggacacgtcatgaaccgcttctccctgaaactgacctccgtgaccgccgcggacacgccgtttatttcttgtgcaggcgagactgtctttcaatctatggggccgtggcaccctggtcactgtctcctcagcttcaccaaggcccatcggtcttcccctggcgccctgctccagggcacctctggggcacagcggccctgggctgcctggtcaaggac

SEQ ID NO: 791518 - DNA, 708 bp, Homo sapiens
  misc_feature: 32368.44.27.C05.1.pb.heavy.1.raw 32368
ctatgcgccttgccagcccgctcagacaggtatataggaagtagtccttgaccaggcagcccagggccgctgtgctctcggaggtgctcctggagcagggcgccaggggggaagaccgatgggcccttggtggaggccgaggagacggtgaccagggttccctggccccgaggcgtcgaatgaaccgattttggaaacagatagtctcgcacaaaaatacacggccgtgtcctgagggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactgggccacgcctccccagactccacgaattgcacctgacacatgacacctcttaagaggggcaacgaggaaaaccagctcagcccaaactccatggtgagtcctctgtgttccagtgatgatcaccggagtggaaacaccgcgacttccagtgctgggctcgtctcccaggcccaaacccttcgatcgcgtctaaatcgagcaccggtcgtgtatatactgtctgatggcgcgagggaggcgataccg

SEQ ID NO: 791519 - DNA, 701 bp, Homo sapiens
  misc_feature: 32377.44.55.E11.1.pb.heavy.1.raw 32377
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccaggcgttccctggccccagaagtcaaacgaataataaccactcgagcgccgacttgtctcgcacagtaatagacggccgtgtcgtcgcctctcaggttgttcattgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggaccccccaggctggactaagcctcctccagactccatcaggccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 791520 - DNA, 694 bp, Homo sapiens
  misc_feature: 32431.44.36.D03.1.pb.heavy.1.raw 32431
cgtatcgcctcctcgcgccatcagacgtatatacacgaccggtgctcgatttagctgcgtcacgatctctcttggggagctctgagagcggagccccagccccaaaatcccaggtgttttcatttggtgatcagcactgaacacagaggactcaccatggagttcggctgagctggggttttccttgttgttattttacaaggtgtccagagtgaagtgcagtggtggagtccggggagacttggtccagcctgagggtccctgagactctcctgtgtcgcctctggattcaccatcagtgaccactatatggactgggtcgccaggctccagggaaggggctggagtggcttggccgcagtaaaaacaaagtgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccaggaaccctggtcaccgtctcctcagcctccaccaagggcccatcggtcttcccctggcgccctgctccaggagcacctccgagagcacagcggccctgggctgcctggtcaaggactacttcctatatactgtctgagcgggcggcaaggcgcatag

SEQ ID NO: 791521 - DNA, 709 bp, Homo sapiens
  misc_feature: 32440.44.55.E11.1.pb.heavy.1.raw 32440
ctatgcgcctgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgtttcctggaattgtccctggagatggtgaatcgcccttcacggagtctgcgtaagtatgtgaaatcaccagtataaatgactgagaacccactccagccccttccctggagcctggcgggacccaaactcatgtagttgctgctgacggtgagcccagaggcctgcacaggagagtcttctgggaccccccaggctggactaagcctcctccagactccatcagccgcacctcacactggacacctttttaaaagtccaacaaggagaacccagctcagccaaaactccatggtgagtcctctgtgttcaagtgctgatcaccgaatggaaacactcggaatcccagtgctgggctcctctccccaaacccaacgtgcgagtgctaaatcgagcaccggtcgtgtatatactgtctgatggcgcgagggaggcgatacg

SEQ ID NO: 791522 - DNA, 697 bp, Homo sapiens
  misc_feature: 32465.44.55.E11.1.pb.heavy.1.raw 32465
ctatgcgcgccttgccagcccgctcagacagtatataggaagtagtccttgaccaggcagcccagggccgctgtgccccagaggtgctcttggaggagggtgccagggggagaccgatgggcccttggtggaggcggaggcgacggtgaccaggttccctggccccgaaagtcaaacgataataaccactcgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccactccagcccctttcctggagcctggcggacccaaactcatgtagttgctgctgacggtgagcccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccacgtgcgagtgctaaatcgagcaccggtcgtgtatatactgtctgatggcgcgagggaggcgatacg

SEQ ID NO: 791523 - DNA, 627 bp, Homo sapiens
  misc_feature: 32550.UNK.UNK.UNK.pb.heavy.1.raw 32550
cgtatcgtcctcccttcgggcgccatcagacagtatatacacgaccggttggctcgatttagttaacgaccgtgattagggattggggcaggtgaacacctgtggtttttcccctgctggtggcagctcccagatgggtcctgtcccaggtgcagctgcaggagtcgggccccagactggtgaggccttcggaaccctgtctcttcatctgcactgtctctggagtttccatcagtttctgaatcattcttgggctggatccggcagcccccagggaggggaatggagagtggattggtgacatccattatactgggggcgacgtactactctccgtccctcaagagtcgtctccaccatttcgagggacacgtccatgaaccgcttctccctgaaaactgacctccgtgaccgccgcggacacggcgcgttattctgtgcgagcgagacggtctttcaatccatgggcgtggcaccctggtcactgtctcctcagcttccaccaagggcccatcggtcttcccctggcgccctgctccaggagcacctctgggggcacagcggccctgggctgcctggtcaaggactacttcctatatactgtctgagcggctggcaggcgcatag

SEQ ID NO: 791524 - DNA, 639 bp, Homo sapiens
  misc_feature: 32554.UNK.UNK.UNK.pb.heavy.1.raw 32554
cgtatcgcctccctcgcgccatcagacagtatatacacgccggtgctcgattagtgctatagacttgggtttgggatgctttctgagagtcaaggacctcctgtgcaagaacagaagcacctgtggtttttcctcctgctggtggcagctcccagatgggtcctgtcccaggtgcagctgcaggagtcgggcccaggactggtgaggccttcgggaccctgtctctcatctgcactgtctctggagtttccatcagttctgatcattcttggggctggatccggcagcccccagggaggggaatggagtggattggtgacatccattatactggggcggacgtactactccgtccctcagagtcgtctcaccatttcgagggacacgtccatgaaccgcttctccctgaactgacctccgtgaccgccgcggacacgccgttatttctgtgcgaggcgagactggtctttcaatctatggggccgtggcccctggtcactgtctcctcagcttccccaagggcccatcggtcttcccctggcgccctgcccaggagcacctctgggggcacagcggccctgggctgcctgtcaaggacttacttcctattactgtctgagcgggctgcaaggcgcatag

SEQ ID NO: 791525 - DNA, 716 bp, Homo sapiens
  misc_feature: 32562.UNK.UNK.UNK.pb.heavy.1.raw 32562
ccagcccgctcagacagtatataggaagagtggtcttgaccaggcagccccaggggcgctgtgcccccagaggtgctcttggaggagggtgccagggggaagaccgatgggcccccttggtggaggctgaggagacggtgaccgtggtcccttggcccagacgtccataccgtagtagctagtcccacgcaggtggtagtactacaatatgtcctcgcacagtaatacacagccgtgtcctcggctctcaggctgttcatttgcagatacagcgtgtctcggaattgtctctggagatggtgaatcggcccttcacggagtctgcatagtatttattacttccatcataccatataagtgccacccactcagcccttgcctgagcctggcggacccagtgcatgccataggtactgaaggtgaatccagacgctgcacaggagagtctcaggggacctcccaggctggaccacgcctccccccagactcaacagctgcacctgacactggacacctcttaaaaagagcaacgaggaaacccagctcagcccaaactccatggtgagtcctctgtgtgttcagtgctgatcaccgaatggaaacaccgccgacttctagtgctgggctcctctcccagagcctccccgcgactgagtgatactaaaacgagcaccgcgtcgtcgtatactgtctgatggccgcgaggaggcgatacg

SEQ ID NO: 791526 - DNA, 699 bp, Homo sapiens
  misc_feature: 32563.44.55.E11.1.pb.heavy.1.raw 32563
ctatgcgccttgccagcccgctcagacagtatataggaagtagtccttgaccaggcagccagggccgctgtgcccccagaggtgctcttgaggagcgggtgccagggggaagaccgatgggcccttggtggaggcggaggccgatggtgaccagggttccctgggcccagaagtcaaacgaataataaccactccgagcgccgacttgtctcgcacagtaatagacggccgtgtcgtcgcctctcaggttgttcatttgaagataaaccgtgttcgctggaattgtccctggagatgtgaatcgcccttcacggagtctggcgtagtatgtgaaatcaccagtataaatgactgagaacccactccagcccctccctggagcctggcggacccaactcatgtagttgctgctgacggtgagcccagaggctgcacaggaggtctctggacgccccaggctggactaagcctcctccagactccatcagccgcacctcacactggacacctttaaaagtccaacaaggagaaaccagctcagccaaaactccatggtgagtcctctgtgttcagtgctgatcacgaatggaaacacctcggaatcccagtggctgggctcctctcccccaacccaacgtgcgagtgctaatcgagcaccggtcgtgtatatactgtctgatggcgcgaggaggcgatacg

SEQ ID NO: 791527 - DNA, 706 bp, Homo sapiens
  misc_feature: 32582.44.27.C05.1.pb.heavy.1.raw 32582
cgtatcgcctccctcgcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccagtagggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791528 - DNA, 689 bp, Homo sapiens
  misc_feature: 32593.UNK.UNK.UNK.pb.heavy.1.raw 32593
cgtatcgcctccctcgcgccatcagacagtatatacacgaccgggtgctcgatttagatctactgacaaccacattcctcctctaaagaagcccctgggagcacagctcatcaccatggactggacctggaggttcctcttgttggtggcagcagcaacaggtgtccagtcgcctggtgcaactggtgcagtctgggactagaatgccgcaaccttggtcctcggtgaccctttcctgcacggcctctggaagtactaccagttccactacttataccatcaactgggttgcgcgccaggcccctggacaagggcttgagtggcatgggtggatcatccctctttttggctcactcacctacgcacgagacttccgggcagaattacgattacgcgcggacaagtccacagacacagtctccatgacaatgagttctttgaaatccgacgacacggccgtctactactgtgcgagacggtccgtaccgccagctcgcatggagcctttgagatctgggggggcagggaaccctggtcattgtcacctcagcttccacaagggcccatcggtcttcccctggcgcccctgctccaggagcaccctctgggggcgcacagcgggcctgggctgcccctgggtcaagggactacttcctatatactgtctgagcgggctgcaaggcgcatag

SEQ ID NO: 791529 - DNA, 594 bp, Homo sapiens
  misc_feature: 32598.UNK.UNK.UNK.pb.heavy.1.raw 32598
gaaggctgggcaggctatgcaccctggtccaggtcaaaagctgcggaaccgctagcggccatctggccactagggtcccgcagattcatattgtcggtctagcatgcacaatgctgcaaacccgcttgcaatgccacagcaagcggccaatctttacgccacgttgaattgtttattactgtgactggctatggcttgcaacgcactcgtaaaactagtactttgcggttagggaagtagacaaacccattactccacttcccggaagttcaactcattccaacacgaaataaaagtaaactcaacaccccaagcaggctatgtggggggtgataggggtggattctatttcctatccatccctaggatctcaattaagttactagcgagttaaatgtctgtagcgatccgtcagtcctatcgcgcgcatcaagacctggttggtgagcgtgcagtagatcatcgataagctgcgagttaggtcatcccagaccgcatctgcgcctaaacgttcagtggtagctaaggcgtcaccttcgactgtctaaagcaatatgtcgtccttagctccaagtccctagcaagcgtgtcggg

SEQ ID NO: 791530 - DNA, 663 bp, Homo sapiens
  misc_feature: 32605.44.12.B01.1.pb.heavy.1.raw 32605
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagcccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacagtgcttcatgttcttgcacaggaggtccatgactctcagaaagcccccgcggaatctacactactaaatcgagcaccggtcgtgtatatactgtctgatggcgcgagggaggcgatacg

SEQ ID NO: 791531 - DNA, 691 bp, Homo sapiens
  misc_feature: 32617.UNK.UNK.UNK.pb.heavy.1.raw 32617
ctatgcgccttgccagcccgctcagacagtatataggaagtagtccttgaccaggcagccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtctcggtttcaggttagtcattcggcagaatcaatgagttcttgaagtcatctctgagagggtgaatctggctttcacagacgcggcgtactctgtgataaagctggcaactttgttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaacccagctcagcccgaactccatggtgagtcctctgtgttcagtgctgatcaccaaatgaaaacacctgggaattctggggctggggctccgctctcccccaagagagatcgtgacgcagctaaatcgatcacggtcgtgtatatactgtctgatggcgcgagggaggcgatacg

SEQ ID NO: 791532 - DNA, 698 bp, Homo sapiens
  misc_feature: 32618.UNK.UNK.UNK.pb.heavy.1.raw 32618
cgtatcgcctccctcgcgccatcagacagtatatacacgaccggtgtcgatttaggcactcgcacgttggttttgggggagaggagccagcactgggattccgaggtgtttccattcggtgatcagcactgaacacagaggactcaccatggagttttggctgagctgggttctccttgttggacttttaaaaggtgtccagtgtgagtgcgctgatggagtctggaggaggcttagtccgcctggggggtcccagagactctcctgtgcagcctctgggctcaccgtcagcagcaactacatgagttgggtcgccaggctccagggaaggggctggagtgggtctcagtcattttatactgtgatttcacatactaccgcagactccgtgaagggccattcaccatctccagggacaattccaggaacacggtttatcttcaaatgaacaacctgagaggcgacgacacggccgtctttactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791533 - DNA, 738 bp, Homo sapiens
  misc_feature: 32621.UNK.UNK.UNK.pb.heavy.1.raw 32621
ctatgcgccttgccagcccgctcagacagtatataggaagtatcccttgaccaggcagcccagggccgcgtgcccccccagagtgctattggaggagggtgccagggggaagaccgcatggcccttggtggaggctgaggagacggcgaccgtgtcccgtggcccaggcgtccataccattgagtagagcatgtcatatctgtatccacgagccccatctctcgcaacagtagtagacagccgtgtcctcggctctcaggctattcatttccagatatagtgtgtttcttcgaattgtctctggagatggtgaatcgggcccttcacggaaatctacataatatttattacttccatcataccatataagtgccacccactccagtcccttgcctggagcctggcggacccagtgcaatgccatgtctggttgaaggtgaatccagacgctacaccaggaagtctcagggaaccctccaggctggaccacgctcccgcccccccagactccaccgcttcacccgacactgccctcttaaaagagcaacgaggaaaaacccaggtcagcccaaaactcccatgtggtcctctgtgttcggtgctgatcaccgactggaacaccgccgacttctggtgctggggctcctctccagagcttccccaaacccaacgagctcactcctaatcgagcaccggtcgtgtatatactggtctgatggcgcgagggaggcgatacgg

SEQ ID NO: 791534 - DNA, 578 bp, Homo sapiens
  misc_feature: 32629.44.78.H01.1.pb.heavy.1.raw 32629
ctatgcgccttgccagccgctcagacagtatatacggaagtagtccttgaccagcagccaggcgctgtgctctcgaggtgctcctggagcagggcgccaggggaagaccgatggcccttggtggaggctgagagacggtgaccagggttcctggccccacaagtcaagccaggtgctggtggccctctcgcacagaataacacgccgtgtctcagatctcaggctgctcagttccatgtagactgtacctggggaggtgctcctggtcatactaactctgccttggaacttctgggcaaagcccgtgttgccactatagggcttcatcatccatccactccagccttgtccagcgcctgtcgcacccagttaatatcataattgatgaacgtgtatccagaagccgtgcaggagactgtcactgaggccccaggcttcttcacctcagccccagactgcaccagctgtacctggagtgggaccgtcagtctttcctcttcccccaaaccaaactactcacactaaatcgagcaccggtcgtgtatatacctgtctgatggcgcgagggaggcgatacg

SEQ ID NO: 791535 - DNA, 689 bp, Homo sapiens
  misc_feature: 32665.44.36.D03.1.pb.heavy.1.raw 32665
cgtatcgcctccctcgcgccatcagacagtatatacacgaccggtgctcgatttagctgcgtcacgatctctcttggggagctctgagagcggagccccagcccagaattcccaggtgttttcattggtgatcagcactgaacacagaggactcaccatggagttcgggctgagctgggttttccttgtgttattttacaaggtgtccagagtgaagtgcagtggtggagtccggggagacttggtccagcctggaggtccctgagactctcctgtgtcgcctctggattcaccatcagtgaccactatatggactgggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactacctgaaaccgaggacacgggcatgtattattgtgttgtgtttatatcaggaactgtcactgggccagggaaccctggtcaccgtctcctcagcctccaccaagggcccatcgtcttccccctgcgccctgctccaggagcacctccgagagcacagcggccctgggctgcctggtcaaggactattcctatatactgtctgagcggctggcaggcgcatag

SEQ ID NO: 791536 - DNA, 727 bp, Homo sapiens
  misc_feature: 32710.44.27.C05.1.pb.heavy.1.raw 32710
cgtatcgcctccctcgcgccatcagacagtatatacacgaccggtgctcgatttagacgcgatcgaagggtttggggagccctgggagacgagcccagcactggaagttcgccggtgtttccactcggtgatcatcactgaacacagaggactcaccatggagtttttgggctgagctgggtttttcctcgttgccctcttaagaggtgtcatgtgtcaggtgcaattcgtggagtctggggggaggcgtggccccagtaggggggtccctgagactctcctgtgcagcctctggattcaccttcgataattggaatatgcagtgggtccgccaggctccaggcgagggggctggagtgggtggcaggtgtgtcatttcatggaggaaatcaaggtctacggtgattccgttgagggccgattcaccatctccagagacaattccgagaacacagtgtctcttcaaatgaacagcctgagacctcaggacacggccgtgtatttttgttgcgagactatctgtttccaaaatcggttcatttcgacggcctggggccagggaaccctggtcaccgtctcctcggcctccacccaaagggcccccatcggtcttccccctggcgccctgctccaggagcacctcccgagagcacagcggccctgggctgcctggtcaaggactaacttcctatatactgtctgagccggccttggcaaggcgccatag

SEQ ID NO: 791537 - DNA, 724 bp, Homo sapiens
  misc_feature: 32742.UNK.UNK.UNK.pb.heavy.1.raw 32742
ctatgcgccttgccagcccgctcagacagtatataggaagtagtccttgaccaggcagcccagggccgctgtggcccccagaggtgctcctggagcagggcgccaggggaagaccgatgggccctttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgccctcgcactgggacaccttctaaaaaaactacaaggaaaatcaagattagcccaaactccatggttgggtggttctgtgctcagtgctgatcaccaagtggaaactcctgggaatctcacggctggggctcctctcccagagctccccctttgtgtgttcagacggtcctgctaaatccgagcaccggtcgtggtatatactgtctgatggcgcgaggggaggcgatacg

SEQ ID NO: 791538 - DNA, 661 bp, Homo sapiens
  misc_feature: 32755.44.12.B01.1.pb.heavy.1.raw 32755
cgtatcgcctccctcgcgccatcagacagtatatacacgaccggtgctcgattttagtagtgtagattccgcggggcttactgagagtcatggacctcctgtgcaagaacatgaagcacctgtggttcttcctcctgctggtggcggctcccagatgggtctgtcccagctgcagctgcaggagtcggcccaggactggtgaagccttcggagaccctgtccctcacctgcactgtctcttggtggctccatcagccagtagtagttactactggggctggatccgccagcccccagggaaggggctggagtggattgggagtatctattatagtgggagcacctactacaacccgtccctcaagagtcgagtcaccatatcagtagacacgtcaagaaaccagttctccctgaagctgagctctgtgaccgccgcggacacggccgtgtattactgtgcgagagtagggcagttcgtcacaactactttgaccactggggccagggaaccctggtcaccgtctcctcagcctccaccaagggccatcggtcttccccctggcaccctctccaagagcacctctggggcacagcggccctgggctgcctggtcaaggactacttcctatatactgtctgagcgggctggcaaggcgcatag

SEQ ID NO: 791539 - DNA, 673 bp, Homo sapiens
  misc_feature: 32763.44.35.D02.1.pb.heavy.1.raw 32763
ctatgcgccttgccagcccgctcagacagtatataggaagtagtccttgaccaggcagcccagggccgctgtgcccccagaggtgctcttggaggagggtgccaggggaagaccgatgggcccttgtgggaggctgaggagacggtgaccagggttccctggccccaggggtcgagccagttcgccccccgtctctactgtatcgataggaatctctcgcacaataatatacggccgtgtccgcggcggtcacagaagtcaatttcagggagaactggttcttggacctgtctagtgacatgtgactcgactctgagggcggggttgtagttggtgctgccactgttatagatgcgcccaatccactcagtcccttcccggcggactgccgcagccaactccaataataactactgatgtaaccaccagagacattgcaggtgagggacagggtctcgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgagcaccggtcgtgtatatactgtctgatggcgcgagggaggcgatacg

SEQ ID NO: 791540 - DNA, 703 bp, Homo sapiens
  misc_feature: 32779.UNK.UNK.UNK.pb.heavy.1.raw 32779
ctatgcgccttgccagccgctcagacagtatataggaagtagtccttgaccaggcagcccaggccgctgtgcccccagaggtgctcctggagcagggcgccaggggaagacgatgggcccttggtggaagctgaagagacggtgaccattgtcccctgccccaaatatcaaatgcatcgacgtcccaggatcgcctggcgcagtaatagacgcctgtgtcgtcggtctcaggttgctcatttgtaaatgccaacactgttggagtcatcccttgagacggtgaatcttccttcacagacgcggcgtactctttacttccaccataacgtttcattctgacgaaagtgatccactcaagccccttccctggagcctgacggaccaggccaagtgataatcactaagactgaatcctgagactacacaggagagtctcagagaccgccctggctgtgccaagcccccccccgactccgccagtcgccctcgcactggacaccttctaaaaaaactacaaggaaaatcaagattagcccaaactccatggttggtggtctgtgctcagtgctgatcaccaagtggaaactctgggaatctcacgctggggctcctctcccagagctccctttgtgtgttcagaacgtctgctaaatcgagcaccggtcgtgtatatactgtctgatggcgcgagggaggcgatacg

SEQ ID NO: 791541 - DNA, 591 bp, Homo sapiens
  misc_feature: 32781.UNK.UNK.UNK.pb.heavy.1.raw 32781
gaaggctgggcaggctatgcaccctggtccaggtcaaaagctgcggaaccgctagcggccatcttggccactagggtcccgcagattcatattgtcgtctagcatgcacaatgctgcaaaccagcttgcaatgcccacagcagcggccaatctttacgccacgttgaattgtttattacctgtgactggctatggcttgcaacgccactcgtaaaactagtactttgcggttaggggaagtagacaaaccattactccacttccggaagttcaactcattccaacacgaaataaaagtaaactcaacacccaagcaggctatgtggggggtgataggggtggattctatttcctatccatccctaggatctcaattaagttactagcgagttaaatgtctgtagcgatccgtcagtcctatcgcgcgcatcaagacctgttggttgagcgtgcagtagatcatcgataagctgcgagttagtcatcccagaccgcatctggcctaaacgttcagtggtagctaaggcgtcaccttcgactgtctaaaggcaatatgtcgtccttagctccaagtcctagcaagcgtgtcgg

SEQ ID NO: 791542 - DNA, 665 bp, Homo sapiens
  misc_feature: 32783.44.6.A06.1.pb.heavy.1.raw 32783
ctatgcgccttgccagcccgctcagacagtatataggaagtagtccttgaccaggcagcccagggccgctgtgcccccagaggtgctcctggagcaggcgccaggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccgaagtctcgtgcgtaggtgagtgagccaaaaagaggatgattccacccatccactcaagcccttgtccagggcctggcgcacccagttgatggtataagtagtggaactggtagtacttccagaggccgtgcaggaaaggtcaccgaggaccaaggttgcggcattctagtcccagactgcaccagttgcaccagggactggacactgttgctgctgccaccacaaagaggaacctccaggtccagtccatggtgatgagctgtgctcccagggctctttagaggaggaatgtggttgtcagtagatctaaatcgagcaccggtcgtgtatatactgtctgatggcgcgaggaggcgatacg

SEQ ID NO: 791543 - DNA, 609 bp, Homo sapiens
  misc_feature: 32784.44.23.C01.1.pb.heavy.1.raw 32784
ctatgcgccttgccagccgctcagacagtatataggaagtagtccttgaccaggcagcccagggccgctgtgcccaagaggtgctcctggagcagggcgccagggggaagaccgatgggccttggtggaaggctgaggagacagtgaccagggtgccacggcccatagattgaaagaccaagtctcgcctcgcacagaaataaacggccgtgtccgccggcgtcacggagtcagtttcaggagagcggttcatggacgtgtccctcgaaatggtgagacgactcttgaggacggagagtagtacgtcgccccagtataatggatgtcacaatccactccatttccctccctggggctgccggatccagcccaagaatgatcagaactgatggaaactccagagacagtgcagatgagagacaggttcccgaaggcctcaccagtcctgggcccgactcctgcagctgcacctggacaggacccatctgggagctgccaccagcaggaggaaaaacacaggtgttcaccctgcccaatccctaatcacgtgtactaaatcgagcaccggtcgtgtatatactgtctgatggcgccgagggaggcgatacg

SEQ ID NO: 791544 - DNA, 543 bp, Homo sapiens
  misc_feature: 32786.UNK.UNK.UNK.pb.heavy.1.raw 32786
ctatgcgcctgccagccgctcagacagtatataggaagtagtccttgaccaggcagcccagggccgctgtgcccccagaggtgctcctggagcaggcgccagggggaagaccgatgggcccttggtggaagctgaggagacggtgaccgtggtcccttggccccagacgtccataccgtagtagtagtatgcaactccccgaactccgcaccggctcttgcacagtaatacacagccgtgtcctcggctctcagactgttcatttgcagatacagcgtgttcttggcgttgtctctggagatggtgaatcgggcccttcacggagtccgcgtagcttgtgctaccccatcactattaatacgtgagacccacaccagccccttccctggagcttggcggaccccagtgcatccagtagctactgaaggtgaatccagaggctgcacaggagagtccagggacccccaggctgaactatcagatactaaatcgagcaaccggtcgtgtatatactgtctgatggcgcgcgagggaggcgatacg

SEQ ID NO: 791545 - DNA, 658 bp, Homo sapiens
  misc_feature: 32836.44.12.B01.1.pb.heavy.1.raw 32836
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtccagctgcagctgcaggagtcgggcccaggactggtgaagccttcgagaccctgtccctcacctgcactgtctctggtggctccatcagcagtagtagttactactggggctggatccgccagcccccagggaaggggctggagtggattgggagtatctattatagtgggagcacctactacaacccgtcctccagagtcgagtcaccatatcagtagacacgtccaagaaccagttctccctgaagctgagctctgtgaccgccgcggacacggccgtgtattactgtgcgaagtaggcagttcgtcaccaactactttgaccactgggccaggggaaccctggtcaccgtctcctcagcctccaccaagggcccatcggtcttccccctggcaccctcctccaagagcacctctggggcacagcggccctgggctgcctggtcaaggactacttcctataccctgtctgagcggctggcaaggcgcatag

SEQ ID NO: 791546 - DNA, 723 bp, Homo sapiens
  misc_feature: 32917.44.56.F01.1.pb.heavy.1.raw 32917
cgtatcgcctccctccgcgccatcagacagtatatacacgaccggtgctcgatttagcagacgtctgaacacacaaaaggggagctctgggagaggagccccagccgtgagattcccaggagtttccacttggtgatcagcactgagcacagaccaccaaccatggagtttgggctaatcttgatttttcctttgtagttttttttagaaggtgtccagtgcgaggggcgactggcggagtcgggggggggcttggcacagccagggcggtctctgagactctccctgtgtagtctcaggattcagtcttagtgattatcacttggcctgggtccgtcaggctccagggaaggggcttgagtggatcactttcgtcagaatgaaaacgttatggtggaagtaaagagtacgccgcgtctgtgaagggaagattcaccgtctcaagggatgactccaacagtgttggccatttacaaatgagcaacctgagaccccgacgacacaggcgtctattactgcgccaggcgatcctgggacgtcgatgcatttgatatttggggccagggggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 791547 - DNA, 578 bp, Homo sapiens
  misc_feature: 32942.44.37.D04.1.pb.heavy.1.raw 32942
cgtatcgcctccctcgcgccatcagaacagtatatacacgaccggtgctcgatttagtagcatactgttgggtttagggggaggcgtggtcccagcccgggaggtccctgagactctccactgtgtagcctctgggttctcattcgatagatttggtttgcactgggtccgccaggctccaggcaaggggccggagtggggtggcagtcatctccgacgatggaagtgaagaagtattactcagactccgtgaagggccgattcaccatctccagagacaattccaagaatatgctgtatttgcaaatgaacagcgtgagagttgacgacacgtctgtttatttactgtgcgaggggacctccaaggaaacggtttcggggaatcataactacactatttgatggatggtctggggcagggggacgtcggtcaccgtctcctcagcttccaccaagggcccatcggtcttcccccggcgccctgctccaggagcacctctgggggcacagcggcccctgggctgccggtcaaggactacttcctatatactgtctgagcgggctggcaagggcgatag

SEQ ID NO: 791548 - DNA, 618 bp, Homo sapiens
  misc_feature: 32946.44.36.D03.1.pb.heavy.1.raw 32946
cgtatcgcctccctcgcgccattcagacagtatatacacgaccggtgctcgattttagctgcgtcacgatctctccttgggtcttgtcccaggtcaccttgaggagtctggtcctgtgctggtgaaaccccacagagacccctcacgctgacctgcaccatctctgggttctcctctcaacgatattagaatgggtgtgagctggatccgtcagcccccagggaaggccctggagtggcttgcacacatcttctcgaatgacgaaaaaatcctacagtacatctctgaagagcagtttaaccatctccaaggacacctccaaaaggcaggtggtctttagtatgaccaacatggaccctgcggacacaggcacatattactgtgcacgggtaatgcggggaaagaaacagctggttttctgtattataagtcttaccatctggacgtctggggccaaaagggaccacggtcaccgtctcctcagcttccaccaagggcccatcggtctttccccctggcgccctgctccaggagcacctctgggggcacagcggcctggctgcctggttcaaggactacttcctatatactgtctgagcgggctggcaaggcgcatag

SEQ ID NO: 791549 - DNA, 603 bp, Homo sapiens
  misc_feature: 32984.UNK.UNK.UNK.pb.heavy.1.raw 32984
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatggtttgtctacttcccctaaccgcaaagtactagttttacgagtggcgttgcaagccatagccagtcacaggtaataaacaattcaacgtggcgtaagattggccgcttgctgtgggcattgcaagctgggtttgcagcattgtgcatgctagacgacaatatgaatctgcgggacccctagtggccagatggccgctagcgggttccgcagcttttgacctggaccagggtgcatagcctgcccagccttc

SEQ ID NO: 791550 - DNA, 700 bp, Homo sapiens
  misc_feature: 32995.44.27.C05.1.pb.heavy.1.raw 32995
ctatgcgccttgccagcccgctcagacagtatataggaagtagtccttgaccaggcagcccagggccgctgtgctctcggaggtgctcctggagcagggcgccagggggaagaccgatgggccctggtggaggccgaggagacggtgaccagggttccctggccccaggggtcgaatgaaccgattttggaaacagatagtctcgcacaaaaatacacggccgtgtcctgaggtctcaggctgttcatttgaagagacactgtgtttctcggaattgtctctggagatggtgaatcggccctcaacggaatcaccgtagacttgatttcctccatgaaatgaccacctgccacccactccagcccctcgcctggagcctggcggaccccactgcatattccaattatcgaaggtgaatccagaggctgcacaggagagtctcaggaccccctactggggcacgcctcccccagactccacgaattgcacctgacacatgacacctcttaagagggcaacgagaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatatactgtctgatggcgcgagggaggcgatacg

SEQ ID NO: 791551 - DNA, 697 bp, Homo sapiens
  misc_feature: 33016.UNK.UNK.UNK.pb.heavy.1.raw 33016
cgtatcgcctccctcgcgccatcagacagtatatacacgaccggtgctccgatttagctacgactgcaagggaaaggggagagaggagccttagccctggactcaaggcctttccacttggtgatcagcactgagcacagaggactcaccatggaattgggactgagctgggttttccttgttgctattttagaaggtgtccagtggtgaggtgcaactggtggagtctgggggaggcttggtccagcctggggggctccctggagactctcctgtgcagcctctggattcacctttagtagttattggatgaactgggtccgcgccaggctccagggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactgggtcagggaacccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791552 - DNA, 624 bp, Homo sapiens
  misc_feature: 33019.44.23.C01.1.pb.heavy.1.raw 33019
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgccaggagtcggcccaggactggtgaggccttcgggaaccctgtctctcatctgcactgtctctggagtttccatcagtttctgatcattcttggggctggatccggcagcccccagggaggggaatggagtggattggtgacatccattatactggggcgacgtactactctccgtccctcaagagtcgtctcaccatttcgaggggacacgtccatgaaccgctttctccctgaaactgacctccgtgaccgccgcggacacggccgtttatttctgtgcgaggcgagactggtctttcaatctatggggcccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctgcaaggcgcatag

SEQ ID NO: 791553 - DNA, 677 bp, Homo sapiens
  misc_feature: 33037.44.12.B01.1.pb.heavy.1.raw 33037
ctatgcgccttgccagcccgctcagacagtatataggaggagtagtccttgaccaggccagccagggccgctgtgccccagaggtgctcttggagggaggtgccagggggaagaccgatgggccccttggtgaggctgaggagacggtgaccaggggttccctgggccccagtggctcaaagtagttggtgacgaactgccctactctcgccacagtaatacacggccgtgtccgcggcggtcacagagctcagcttcagggagaactggttcttggacgctgtctactgatatggtgactcgactctttgagggacgggttgtagtaggtgcgctcccactataatagatactcccaatccactccagccccttccctgggggctggcgatccagccccagtagtaactactactggctgatggagcaccagagacagtgcaggtgaggacagggtctccgaaggcttcaccagtcctgggcccgactcctgccagctgcagctggacaggacccatctgggagccgccaccagcaggaggaagaaccacaggtgcttcatgttcttggccacaggacggtccatgactctcagaaagcccccgcggaatctacactactaaatcgagcaccggtcgtgtatatactgtctgatggcggcgaggagggcgatgacg

SEQ ID NO: 791554 - DNA, 662 bp, Homo sapiens
  misc_feature: 33046.UNK.UNK.UNK.pb.heavy.1.raw 33046
ctatgcgccttgccagcccgctcagacagtatataggaagtagtcctgaccaggcagccagggccgctgtgcccccagaggtgctctggaggagggtgccagggggaagaccgatgggcccttggtggaggctgaggagacggtgaccagggttccctggccccagtggtcaaaagtagttggtgacgaactgccctactctcgcacagtaatacacggccgtgtccgcggcggtcacagagctcagcttcagggagaactggttctggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcagggtgagggacagggtctcgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggttcgtgtatatactgtctgatgcgcgagggaggcgatacg

SEQ ID NO: 791555 - DNA, 696 bp, Homo sapiens
  misc_feature: 33048.44.56.F01.1.pb.heavy.1.raw 33048
cgtatcgcctccctcgcgccatcagacagtatatacacgaccggtgctcgatttagcagacgtctgaacacacaaaggggagctctgggagaggagccccagccgtgagattcccaggagttttccacttggtgatcagcactgagcacagaccaccaaccatggagtttgggctaatcttgattttccttgtagttttttagaaggtgtccagtgcgaggggcgactggcggagtcggggggggctttggcacagccagggcggtctctgagactctcctgtgtagtctcaggatttcagtcttagtggattatcacttgctgggtccgtcaggctccagggaaggggcttgagtggatcactttcgtcagaatgaaacgttatggtggaagtaaagagtacgccgcgtctgtgaaggaagattcaccgtctcaagggatgactcaacgtgtggccattttacaaatgagccaactgggacccgacgacacaggcgtctatactgcgccaggcgatcctgggactcgatgcatttgatatttggggccaggggacaatggtcacgtctcttcagcttccaccagggccccatcggtcttccccctggcgccctgctccggagcacctctgggggcacagcgccctgggctgcctggtcaaggactaacttcctatatactgtctgagcgggctgg

SEQ ID NO: 791556 - DNA, 707 bp, Homo sapiens
  misc_feature: 33057.44.9.A09.1.pb.heavy.1.raw 33057
cgtatcgcctccctcgcgcgccatcagacagtatatacacgaccggtgctcgatttagcgagacgcgcagggggggagacgagcccagcactggaagtcgccggtgttttccattcggtgatcatcactgaacacagaggactcaccatggactttgggctgagatggggtttttcctcgttgctcttttaagaggtggccagtgttcaggtgcagctagtggagtctggggggaggagcggcccagcctgggaactccctgagactctttctgtgcagcctctggattcatcttcaggacctaatgccatgcactgggtccgccaggctccaggcaaggggctggagtgggtggcaattattatcagaagaatggaattgaaagaacactacggagactccgagaagggccgattctcaccgtctccagagacaattccaggacacactgcatctgcaaatgtacaacctcaacaagtgaggacacggctgtctattattgtgcgagagccccctcgagacggtcccgcttgactactggggccagggaaccctggttcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791557 - DNA, 714 bp, Homo sapiens
  misc_feature: 33068.44.36.D03.1.pb.heavy.1.raw 33068
ctcgtatcgcctccctcgccgccatcagtctatactatcacgaccggtgctcgatttagctgcgtcacgatctctcttggggagctctgagagcggagccccagccccagaattcccaggtgtttttcatttgtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattccaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaacgaggacacggggcatgaatgtattgttattgtttgtgtttatatcaggaaactgtccactggggccagggaaccctggtcacccgtctcctcagcctccaccagggcccatcggtcttccccctggcgccctgctccaggagcacctccgagagcacagcggccctgggctgcctggtcaaggactactttccctatatactgtctgagcgggctggcaggcgca

SEQ ID NO: 791558 - DNA, 620 bp, Homo sapiens
  misc_feature: 33081.UNK.UNK.UNK.pb.heavy.1.raw 33081
cccgacacgcttgctagggacttggagctaaggaccgacatattgcctttagacagtcgaaggtgacgccttagctaccactgaacgtttaggcgccagatgccggtctggggatgacctaactcgcagcttatcgatgatctactgcacgctcaaccaaccaggtcttgatgcgccgcgataggactgacgggatcgctacagacatttaaactcgctagtaacttaattgaggatcctaggggatgggataggaaatagaatccacccctatcacccccccacatagcctgcttggggtggttgagtttacttttatttcgtgttggaatgagttgaacttccgggaagtggagtaatgggtttgtctactttcccctaaccgcaaagtactagttttacgagtggcgttgcaagccatagccagtcacaggtaataaacaattcaacgtggcgtaaaagattggccgcgctgctgtgggcattgcaagctgggtttgcagcattgtgcatggctagacgacaatatgaatctgcgggacccctagtggccaagatggccgctagcgggttccgcagctttttgacctggaccagggtgcatagcctgcccagccttc

SEQ ID NO: 791559 - DNA, 701 bp, Homo sapiens
  misc_feature: 33102.44.36.D03.1.pb.heavy.1.raw 33102
cgtatcgcctccctcgcgccatcagacagtatatacacgaccggtgctcgatttagctgcgtcacgatctctcttggagctctcagagaggtgccttagccctggattccaaggcatttccacttggtgatcagcactgaaacacagaggactcaccatggagttggggctgcgctggttttccttgttgctattttagaaggtgtccactgtgaggtgcggctggtgagtctggggaggcttggtacagcggggggggtccctgagactctcctgtgcagcctctggattcatcttcagtgactatgccatgaactggtccgccaggctccaggaaggggctgagtgggtttcatatgttaattattgctggagataccacctactacgcagactctgtgaagggccgattcaccaattccagggacaatgccaagaactccactgtatctgaaatgaacagcctgagagacgagacacggctgtctacttctgttcgagagatcgggccactggtcagtggctggtttgactactggggcggggaccctggtcaccgtctctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791560 - DNA, 719 bp, Homo sapiens
  misc_feature: 33145.44.85.H08.1.pb.heavy.1.raw 33145
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgagactctcctgtgcagcgtctggattcaccttcagtacctatggcatgcactgggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaaggaccacggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791561 - DNA, 700 bp, Homo sapiens
  misc_feature: 33187.44.36.D03.1.pb.heavy.1.raw 33187
cgtatcgcctcctcgcgccatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggggacttggtccagcctggagggtccctgagactctcctgtgtcgcctctggattcaccatcagtgaccactatatggactgggtccgccaggctccagggaaggggctggagtggcttggccgcaagtaaaaacaaagttgccagctttatcacagagtacgccgcgtctgtgaaagccagattcaccctctcaagagatgacttcaagaactcattgattctgcgaatgactaacctgaaaaccgaggacacgggccatgtattattgtgttgtgtttatatcaggaactgtccactggggccagggaaccctggtcaccgtctcctcagcctccaccaaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791562 - DNA, 642 bp, Homo sapiens
  misc_feature: 33229.44.19.B08.1.pb.heavy.1.raw 33229
cgtatcgcctccctcgcgcctcagacagtatatacacgaccggtgctcgatttagtgagtcagtaaggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagcccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 791563 - DNA, 551 bp, Homo sapiens
  misc_feature: 33246.44.43.D10.1.pb.heavy.1.raw 33246
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccagggtttccctggccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatccatccactcaagcccttgtccagtggcctgtcgcacccagttgatatcataattggtgaaggtgtatccagaagccttgcaggagaccttcactgaggccccaggcttcttcacctcagccccttactgctagtctaaatcgagcaccggtcgtggtatatactgtctgatggcgcgagggaggcgatacg

SEQ ID NO: 791564 - DNA, 683 bp, Homo sapiens
  misc_feature: 33294.44.74.G08.1.pb.heavy.1.raw 33294
ctatggccttgccagccgctcagacagtatataggaagtagtccttgaccaggcagcccagggccgctgtgccccagaggtgctcctggagcagggcgccaggggaagaccgatgggcccttggtggaagctgaggtgacaatgaccagggttcctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggagtctcgtgcgtaggtgagtgagccaaaaagagggatgattccaccatccactcaagcccttgtccaggggcctggcgcacccagttgatggtataagtagtggaactggtagtacttccagaggccgtgcaggaaagggtcaccgaggaccaaggtgcggcattctagtccagactgcaccagttgcacagggactggacacctgttgctgctgccaccacaaagaggaacctccaggtccagtccatggtgatgagctgtgctcccaggggcttctttagaggaggaatgtggttgttatgtgatgctcccctgatagagctactaaatcgagcaccggtcgtgtatatactgtctgatggcgcgagggaggcgatacg

SEQ ID NO: 791565 - DNA, 687 bp, Homo sapiens
  misc_feature: 33368.44.73.G07.1.pb.heavy.1.raw 33368
ctatgcgccttgccagcccgctcagacagtatataggaagtagtccttgaccaggcagcccagggccgcttgtgctctcggaggtgctcctggagcagggcgccagggggaagaccgatgggcccttggtggaggctgaggagacggtgaccagtgtcccctggcccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaaacccagctcagcccaaactccatggtgagtcctctgtgtttcagtgctgatcaccgaatggaaacaccgccgagagcacagcggccctgagcgtagagctaaatcgagcaccggtcgtgtatatactgtctgatggcgcgagggaggcgatacg

SEQ ID NO: 791566 - DNA, 698 bp, Homo sapiens
  misc_feature: 33372.UNK.UNK.UNK.pb.heavy.1.raw 33372
ctatgcgccttgccagcccgctcagacagtatataggaagtagtccttgaccaggcagcccaggccgctgtgctctcggaggtgctcctggagcagggcgccagggggaaagaccgatgggcccttggtggaggctgaggagacggtgaccaggtgtcccctgggccccagtgaaacgcccgataatagctgctgccacttcccgatctcgcacggtaatacagagccgagtcctcgcctctcaggctgatcatttccaggtacagagtgttccggggaattgtctctggagatggtgaatcggcccttcacggagtttcgcataatatctagaaagttccatcatatgctataactgccaaccactccggccccttgcctggagcctgggcgggaccagtgcatgccagaactactgaaactaaatccagaggcttcacaggagagtctcagggacctcccaggctggaccacgcctcccccagactccaccaggtgcacctgaacactggacacctcttaaaagagtaacgaggaaaacccagctcagcccaaactccatggtgagtcctctgtggttcagtggctgatcaccgaatggaaacaccgccgagagcacagcggcctggagcgtagagctaaatcgcagcaccggtccgtgcgtatatactgtctgatggcgcgagggaggcgatacg

SEQ ID NO: 791567 - DNA, 651 bp, Homo sapiens
  misc_feature: 33391.44.86.H09.1.pb.heavy.1.raw 33391
ctatgcgccttgccagcccgctcagacagtatataggaagtagtccttgaccaggcagcccagggccgctgtgcccccagaggtgctcctggagcagggcgccagggggaaagaccgatgggcccttggtggaagctgaggagacagtgaccaggggtgccacggccccatagattgaaagaccagtctcgcctcgcacagaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctggcccgactcctgcagctgcacctggacaggaccatctgggagctgccaccagcaggaggaaaaaaccacaggtgcttcatgttcttgcacaggaggtccttgactctcagaaagcatccccaaacccaagtctatagcactaaatcgagcaccggtcgtgtatatactgtctgatggcgcgaggaggcgatacg

SEQ ID NO: 791568 - DNA, 698 bp, Homo sapiens
  misc_feature: 33419.UNK.UNK.UNK.pb.heavy.1.raw 33419
atcgcctccctcgcgccatcagacagtatatacacgacggtgctcgatttagcagacgtctgaacacacaaaggggagctctgggagaggagccccagccgtgagattcccaggagtttccacttggtgatcagcactgagcacagaccaccaaccatggagtttgggctaatctgattttccttgtagtttttttagaaggtgtccagtgcgaggggcgactggcggagtcggggggggcttggcacagccagggcggtctctgagactctcctgtgtagtctcaggattcagtcttagtgattatcacttggcctggtccgtcaggctccagggagggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttgggccagggacaatggtcaccgtctcttcagcttccaccaagggcccatcggtcttcccctggcgccctgctccaggagcacctctggggcacagcggcctgggctgcctggtcaagactacttcctatatactgtgagcgggctgcaagcgcatag

SEQ ID NO: 791569 - DNA, 691 bp, Homo sapiens
  misc_feature: 33510.UNK.UNK.UNK.pb.heavy.1.raw 33510
ctatgcgccttgccagcccgctcagacagtatataggaagtagtccttgaccaggcagcccagggccgctgtgccccagaggtgctcctggagcagggcgccagggggaagaccgatgggcccttggtggaagctgaagagacggtgaccattgtccctggcccaaatatcaaatgcatcgacgtcccaggatcgcctggcgcagtaatagacgccctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatcactcaagccccttccctggacctgacggacccaggccaagtgataatcactaagactgaatcctgagactacacaggagagtctcagagaccgccctggctgtgccaagccccccccgactcccgccagtcgcccctcgcactggacaccttctaaaaaaactacaaggaaaatcaagattagcccaaactccatggttggtggtctgtgctcagtgctgatcaccaagtggaaactcctgggaatctcacggctgggcctcctctctcttgcgacgacactaaatcgagcaccgtcgtgtatatactgtctgatggcgcgagggaggcgatacg

SEQ ID NO: 791570 - DNA, 731 bp, Homo sapiens
  misc_feature: 33514.UNK.UNK.UNK.pb.heavy.1.raw 33514
ctatgcgccttgccagcccgctcagacagtattaggaagtagtcctttgaccaggcagcccccaggggccgctgtgcccccagagggtgctcttggaggagggtgccagggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttctttcgaattgtctctggagatggtgaatcggccccttcacggaatctacataatatttattacttccatcataccatataagtgccacccactccagtcccttgcctggagcccctggcggacccagtgcatgccatgtctgttgaaggtgatccagacgctacacaggagagtctcagggaccctcccaggctggaccacgcctcccccagactccaccagcttcacctgacactggacacctcttaaaagagcaacgaggaaaacccaggtcagcccaaactccatggtgagtcctctgtgttccggtgctgatcaccgactggaaacaccgccgaccttctggtgctgggcctcctctccagagctcccccaaccccaacgagctcactctaaatcgagcatgtatatactgtctgatggcgcgaggaggcgatacg

SEQ ID NO: 791571 - DNA, 726 bp, Homo sapiens
  misc_feature: 33521.44.11.A11.1.pb.heavy.1.raw 33521
cgtatcgcctccctcgcgccatcagacatatatacacgaccggtgctcgatttagctacgactgcaaagggaaaaggggaagagaggagcccttagccctggactcccaaggcctttccacttggtgatcagcactgagcacaggaggacttcaccatggaattggactgaagcttgggtctctccttttccttgttgctattttagaaggtgtccagtgtgaggtgcaactggtgagtctgggggagctggtccagcctggggggtccctgagactctcctgtgcagccttctggattcaccttttagtagttattggatgaactgggtccgccaggctccagggaaggggctggagtgggtggccatcatgaagaaagatggaactgagaacacactatgtggactctgtgaagggccgattcaccatctccagaagacaacgccaagaactcactgtatctgcaaaacatgaacagtctgagagtcgaggacacggctgtgtattattgtgcgggaggcgctggggtggctcattgactactgggcttggtcagggaaccctgtcaccgtctcctcagcctccaccaagggcccatcggtcttccccctggcgccctgctccaggagcacctccgagagcaccacgccggcccctggtgcctgctgcctggactcaaggactacttccgtatatactgtctgagggcgccgcaaggcgcatag

SEQ ID NO: 791572 - DNA, 544 bp, Homo sapiens
  misc_feature: 33540.44.38.D05.1.pb.heavy.1.raw 33540
cgtatcgcctccctcgcgccatcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcggagttcggggagttgcatactactactacggtatggacgtctggggccaagggaccacggtcaccgtctccctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 791573 - DNA, 691 bp, Homo sapiens
  misc_feature: 33583.UNK.UNK.UNK.pb.heavy.1.raw 33583
ctatgcgccttgccagcccgctcagacagtatataggaagtagtcttgaccaggcagcccagggccgctgtgctctcggaggtgctcctggagcagggcgccagggggaagaccgatgggcccttggtggaggctgaggagacggtgaccagggttccctggccccagtggacagttcctgatataacacaacacaataatacatgcccgtgtcctcggttttcaggttagtcattcgcagaatcaatgagttcttgaagtcatctcttgagagggtgaatctggctttcacagacgcggcgtactctgtgataaaagctggcaacttgtttttactgcggccaagcactccagccccttccctggagcctggcgacccagtccatatagtggtcactgatggtgaatcagagcgacacaggagagtctcagggaccctccaggctgaccaagctcccccgactccaccaactgcacttcactctggacaccttgtaaaataacaacaaggaaaacccagctcagcccgaactccatggtgagtcctctgtgtcagtgctgatcacaaatgaaaacacctggaattctggggctggggctccgctctcagagctccccaagagagatcgtgacgcagctaaatcgagcaccgtcgtgtatatactgtctgatggcgcgaggaggcgatacg

SEQ ID NO: 791574 - DNA, 690 bp, Homo sapiens
  misc_feature: 33593.44.72.G06.1.pb.heavy.1.raw 33593
cgtatcgcctccctcgcgccatcagacagtatataccacgaccggtgctcgattagctacgactgcaagggaaaagggagagaggagccttagccctggactcaaggcctttccacttggtgatcagcactgagcacagaggactcacctggaattgggactgagctgggttttccttgttgctattttagaaggtgtccagtgtgaggtgcaactggtggagtctggggaggcttggtccagcctggggggtccctgagaactctcctgtgcagcctcttggattcacctttagtagttattggatgaactgggtccgccaggctccaggaaggggctggagtgggtggccatcatgaagaaagatggaactgagacacactagatgtggactctgtgaaggggccgatcaccatctccagagacaacgccaagaactcactgtatctgcaaatgaacagtctgagagtcgaggacacggctgtgtattattgtgcgggaggcgctggtggctcattgactactggggtcagggaaccctggtcaccgtctcctcagcctccccaagggcccatcggtcttccccctggcgccctgctcaggagcacctccgagagcacagcggccctgggctgcctggtcaaggactacttcctatatactgtctgagcgggctggcaaggcgcatag

SEQ ID NO: 791575 - DNA, 713 bp, Homo sapiens
  misc_feature: 33604.44.70.G04.1.pb.heavy.1.raw 33604
cgtatcgcctccctcgcgccatcagacagtatatacacgaccggtgctcgatttagtgtagtgtgaagggaaagggtctgggagaggagcccagcactagaagtcggcggtgtttccattcggttgatcagcactgaacacagaggactcaccatggagtttgggctgagctgggttttcctcgttgctctttttaagaggtgtccactgtcaggtgcacctggtggagtctggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagaactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccagggaccctggtccaccgtctcctcagcctccaccaaagggcccatcggtcttccccctggcgccctgctccaggagcacctccgagagcacagcgggccctgggctgcctggtcaaggactactttcctatatactgtctgagcgggctgggcaaggcgcatag

SEQ ID NO: 791576 - DNA, 610 bp, Homo sapiens
  misc_feature: 33630.UNK.UNK.UNK.pb.heavy.1.raw 33630
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagccggccaatctttacgccacgttgaattgtttattacctgtgacctggctatggcttgcaacgccactcgtaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtggccagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791577 - DNA, 723 bp, Homo sapiens
  misc_feature: 33718.44.85.H08.1.pb.heavy.1.raw 33718
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttcccccctggcaccctcctccaagagcacctctgggggcacagcggccctgggctgcctggtcaaggactacttcctatatactgtctgagcgggctggcaaggcgcatag

SEQ ID NO: 791578 - DNA, 602 bp, Homo sapiens
  misc_feature: 33794.UNK.UNK.UNK.pb.heavy.1.raw 33794
cccgacacgcttgctagggacttggagctaaggacgacatattgcctttagacagtcgaaggtgacgccttagctaccactgaacgtttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatcctaggatgggataggaaatagaatccacccctatcaccccccacatagcctgcttggggtgttgagtttacttttatttcgtgttggaatgagttgaacttccggaagtggagtaatgggtttgtctacttcccctaaccgccaaagtactagttttacgagtggcgttgcaagccatagccagtcacagtaataaacaattcaacgtggcgtaaagattggccgcttgctgtggcattgcaagctgggtttgcagcattgtgcatgctagacgacaatatgaatctgcgggacccctagtgggccaagatggccgctagcgggttccgcagctttgacctggaccagggtgcatagcctgcccagccttc

SEQ ID NO: 791579 - DNA, 698 bp, Homo sapiens
  misc_feature: 33885.44.55.E11.1.pb.heavy.1.raw 33885
gtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaatccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 791580 - DNA, 682 bp, Homo sapiens
  misc_feature: 33892.44.45.E01.1.pb.heavy.1.raw 33892
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattcctttactccatcagaccagatgactgccacccactccagccccttgcctggagcctggcggaccagtgcatggcagagtcactgaaactgagtccggacgcaacacaggagagtctcagggacgtcccaggctggaccacgcctccccagactccaccagctgaacctgacactggacacctcttaaaagagcaacgaggaaaacccaggctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791581 - DNA, 671 bp, Homo sapiens
  misc_feature: 33895.44.6.A06.1.pb.heavy.1.raw 33895
cgtatcgcctccctcgcgccatcagacagtatatacacgaccggtgctcgatttagatctactgacaaccacatcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttcccctggcgccctgctccaggagcacctctgggggcacagcggccctggctgcctggtcaaggactacttcctatatactgtctgagcgggctggcaggcgcatag

SEQ ID NO: 791582 - DNA, 680 bp, Homo sapiens
  misc_feature: 33898.44.73.G07.1.pb.heavy.1.raw 33898
cgtatcgcctccctcgcgccatcagacagtatatacacgaccggtgctcgatttagctctacgctcagggccgctgtgctctcggcggtgtttccattcggtgatcagcactgaacacagagactcaccatggagtttgggctgagctgggttttcctcgttactcttttaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaagggccggagtggttggcagttatagcatatgatggaacttctagatattatgcagactccgtgaagggccgattcaccatctcagagacaattcccggaacactctgtacctggaaatgatcagcctgagaggcgagactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791583 - DNA, 690 bp, Homo sapiens
  misc_feature: 33899.44.74.G08.1.pb.heavy.1.raw 33899
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggctctggaagtactaccagttccactacttataccatcaactgggtgcgccaggccctggacaagggcttgagtggatgggtggaatcatccctctttttggctcactcacctacgcacgagacttccgggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 791584 - DNA, 710 bp, Homo sapiens
  misc_feature: 33902.UNK.UNK.UNK.pb.heavy.1.raw 33902
ctatgcgccttgccagcccgctcagacagtatataggaagtagtccttgaccaggcagcccagggccgctgtgcccccagaggtgctcttggaggagggtggccagggggaagaccgatgggcccttggtggaggcggaggcgacggtgaccagggtttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggaccccaactcatgtagttggctgctgacggtgagcccagaggctgcacaggagagtctctgggacccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggctcctctccccccaaacccaacgtgcgagtgctaaatcgagcaccggtcggtgtatatactgtctgatggcgcgagggaggcgatacg

SEQ ID NO: 791585 - DNA, 680 bp, Homo sapiens
  misc_feature: 33905.44.45.E01.1.pb.heavy.1.raw 33905
ctatgcgccttgccagcccgctcagacagtatataggaagtagtcttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcgcccttcacggagtttccatagtattctttacttccatcagaccagatgactgccacccactccagccccttgcctggagcctggcggacccagtgccatggcagagtcactgaaactgagtccggacgccaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagccccttcccttactgactcactaatcgagcaccggtcgtgtatatactgtctgatggcgcgaggaggcgatacg

SEQ ID NO: 791586 - DNA, 703 bp, Homo sapiens
  misc_feature: 33910.44.27.C05.1.pb.heavy.1.raw 33910
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgcctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791587 - DNA, 677 bp, Homo sapiens
  misc_feature: 33911.44.53.E09.1.pb.heavy.1.raw 33911
cgtatcgcctccctcgcgccatcagacagtatatacacgaccggtgctcgatttagagagagtgtgttgagctctgggagagagccccagccttgggattccaggtgttttcattcagtgatcaggactgaacacagaggactcaccatggagtttgggctgagctggattttccttgctgctattttaaaaaggtgtccagtgtgaggtgcagttggtggagtctggggaggtttggtaaagccctggggagtcccttagactctcctgtgcagcctctggattcactttcagtaaacgcctggatgacctgggtccgccaggctccagggaaggggctggagtgggttggccgtattagaaccaaagctgacggtgggacagcagactacgctgcacccgtgaaaggcagattcaccatctcagagatgatcaaaagatacggtgtctctgcagatgaacagcctgaaaccgaggacacagccgtctattactgtctgggatggtttcattcgggccagggaaccctggtcaccgtctcctcagcctccaccagggcccatcggtcttcccccctggcgcctgctccagagcacctccgagagcacagcggccctgggctgcctggtcaaggactactcctatatactgtctgagcgggctggcaaggcgcatag

SEQ ID NO: 791588 - DNA, 691 bp, Homo sapiens
  misc_feature: 33912.44.73.G07.1.pb.heavy.1.raw 33912
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggcccttctcggagtctcccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctggctcgtctcccccctgagcgtagagctaaatcgagcaccggtcgtgtatatactgtctgatggcgcgagggaggcgatacg

SEQ ID NO: 791589 - DNA, 661 bp, Homo sapiens
  misc_feature: 33925.UNK.UNK.UNK.pb.heavy.1.raw 33925
cgtatcgcctccctcgcgccatcagacagtatatacacgaccgggtgctcgatttagtagtgtagattccgcgggggctttctgagagtcatggacctcctgtgcaagaacatgaagcacctgtggttcttcctcctgctgtggcggctccagatgggtcctgtcccagctgcagctgcaggagtgcgggcccaggactggtgaagccttcggagaccctgtccctcacctgcactgtctctggtggctccatcaggcagtagtagttactactgggctggatccgccagcccccagggaaggggctggagtggattggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccacaagggcccatcggtcttcccctggcaccctcctccaagagcacctctgggggcacagcgccctggggctgcctggtcaaggactacttcctatatactgtctgagcggctggcaaggcgcatag

SEQ ID NO: 791590 - DNA, 676 bp, Homo sapiens
  misc_feature: 33974.44.86.H09.1.pb.heavy.1.raw 33974
cgtatcgcctcccctcgcgccatccagaccagtatatacacgaccggtgctcgatttagtgctatagacttgggtttggggatgctttctggaagtcaaggacccctcctgtgccaagaacatgaagcacctgtggtttttcctcctgctggtggcagctcccagatgggtcctgtcccaggtgcagctgcaggagtcggcgcccaggacttggtgaggccttccgggaaccctgtctctcatctgcactgtctctggagtttccatcagttctgatcattcttggggctggatccggcaggcccccagggaggggaatggagtggattggtgacatccattatactggggcgagtactactctcgcgtccctcaagagtcgtctcaccaatttcgaaggacacgtccatgaaccgccttctccctgaaactgacctccgtgaccgcgccgcggacacggccgtttatttcctgtgccgaggcgagactggtctttcaatctatggggccgtggcaccctggtcactgtctcctcaggcttccaccaagggcccatcggtcttccccctggccggcctgctccaggagcacctctggggccacagcggccctgggctgcctggtcaaggactacttcctatatactgtctgaggcgggctggccaaggcgcaatag

SEQ ID NO: 791591 - DNA, 709 bp, Homo sapiens
  misc_feature: 34034.44.27.C05.1.pb.heavy.1.raw 34034
cgatcgcctccctcgcgcccattcagacagtatatacacgaccggtgctcgatttagacgcgatcgaaggggtttggggctgggagacgagccagcactggaagtcgccggtggtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggggtcctgagactctcctgtgccagcctctgattcaccttcgataattggaatatgcagtgggtccgccaggctccaggcgaggggctggagtgggtggcaggtggtgtcatttcatggaggaaatcaagtctacggtgattccgttgagggccgattcaccatctccagagacaattccgagaacacagtgtctcttcaaatgaacagcctgagacctcaggacacggcgtgtatttttgtgcgagactatctgtttccaaaatcggttcattcgacgcctggggccagggaaccctggtcaccgtctcctcggcctccaccaagggcccatcggtcgctccccctggcgccctgctccaggagcacctccgagagcacagcggccctgggctgccctggtcaaggactacttcctatatactgtctgaagcgggctggcaaggcgcatag

SEQ ID NO: 791592 - DNA, 664 bp, Homo sapiens
  misc_feature: 34055.UNK.UNK.UNK.pb.heavy.1.raw 34055
ctatgcgccttgccagcccgctcagacagtatataggaagtagtccttgaccaggcagcccaggccggctgtgccccagaggtgctcttggaggagggtgccaggggaagaccgatgggcccttggtggaggctgaggagacggtgaccagggttccctggcccagtggtcaaagtagttggtgacgaactgccctactctcgcacagtaatacacggccgtgtcgcggcggtcacagagctcagcttcagggagaactggttcttgacgtgtctactgatatggtgactcgactcttgagggacgggttgtagtaggtgctcccactataatagatactcccaatccactccagccccttccctggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagccaggaggaagaaccacaggtgcttcatgtcttgcacaggaggtccatgactctcagaaaaagcccccgcggaatctacactactaaatcgagcaccggtcgcgtgtatatactgtctgatggcgccgagggaggcgatacg

SEQ ID NO: 791593 - DNA, 693 bp, Homo sapiens
  misc_feature: 34058.44.78.H01.1.pb.heavy.1.raw 34058
cgtatcgcctccctcgcgccatcagacagtatattacacgaccggtgctcgatttagtgtgagtagtttgggtttggggaagctatgggagaggagccccagccttgggattcccaggtgttttcattcagtgatcaggactgaacacagaggactcaccatggagtttgggctgagctggattttttccttgctattttaaaaaggtgtccagttgtgaggtgcagttggtggagtctgggggaggtttggtaaagcctggggagtcccttagacctcctgtgcagcctctggattcactttcagtaacgcctggatgacctgggtccgccaggctccagggaaggggctggagtgggttggccgtattagaaccaaaagctgacggtgggacagcagactacgctgcaccgtgaaaggcagattcaccatctcaagagatgattcaaaagatacggtgtctctgcagatgaacagcctgaacaccgaggacacagccgtctattactgtctggatggtttcaattcgggcagggaaccctggtcaccgctctccagcctccaccaagggcccatcgtcttcccccctggcgccctgctccaggagcacctccgagagcacagcggccctgggctgcctggtcaaggacttacttcctatatactgtctgagcgggctggcaaggcgcatag

SEQ ID NO: 791594 - DNA, 722 bp, Homo sapiens
  misc_feature: 34096.44.84.H07.1.pb.heavy.1.raw 34096
cgtatcgcctcccttcgcgcatcagacagtatatacacgaccggtgctcgatttagcagacgtctgtcgcggggagctctgagagaggagcccagccctgggattttcaggtgtttcatttggtgatcaggactgaacagagagaactcaccatggagtttgggctgaggtggctttttcttgtgactattttaaaaggtgtccagttgtgaggtggccctcgttggagtctggggaggattggcacagcccgggggcccgtccctgagacttcctgtgcagctctggcttcccctttaggagctatgccatgacctgggtccgcccaggctccagggaaggggctcgagtggggtctcgacaattggcgctagtgcaactgacacatactacggagagtccgtgaagggcccgcttcaccatctccagagacaattccggaaacacactttttctggaaaatgaacgccctgagagtcgaagacacggccctttatttctgtgcgaagaggggcggggggactggatccacagtgggtgggtggttcaactcctggggccagggagcccctggtcaccgtcgccgcagcctccaccaagggcccatcggtcttccctggcaccctcctccaagagcacctctgggggcacagcggccctggctgcctggtcaaggactactttcctatatactgtctgagcgggctggcaagggcgcatag

SEQ ID NO: 791595 - DNA, 668 bp, Homo sapiens
  misc_feature: 34098.44.12.B01.1.pb.heavy.1.raw 34098
ctatgccgccttgccagcccgctcagacagtatataggaagtagtccttgaccagagcagcccagggccgctgtgcccccaggaggtgctcttggaggaggtgccagggggaagaccgatgggcccttggtggaggctgaggagacggtgaccagggttccctggccccagtggtcaaagtagttggtgacgaactgccctactctcgcacagtaatacacggccgtgtcccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 791596 - DNA, 658 bp, Homo sapiens
  misc_feature: 34112.UNK.UNK.UNK.pb.heavy.1.raw 34112
cgtatcgcctccctcgcgccatcagacagtatatacacgacggtgctcgattagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtggctgggtccgtcagcccccaggaaaggccctggagtggcttgcaactcatttattgggatgatgataggcgctacagtccatctctgaagagcagactctccatcaccggagacgcctccatacgcaggtgatccttagagtgccaacatggccctgcggacacagccacatactactgcgcacacatgatcaactattataaaagtggtggttatgtgagtggctttgatatctggggccaagggacaatggtcaccgtctcttcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791597 - DNA, 684 bp, Homo sapiens
  misc_feature: 34195.UNK.UNK.UNK.pb.heavy.1.raw 34195
cgtatcgcctcctcggcgccatcagacagtatatacacgaccggtgctcgatttagcaacacgatagttgggtttggggatactttctgagacttcatgggcctcctgcacaagaacatgaaacacctgtggtcttcctcctcctggtggcacctcccagatgggtcgtgtcgaggtgcagctgcagggagtcgggccaggacgggtgaagccttcggagaccctgtccctcacctgcaatgttctctggtggttacatcagtagttattaattggagttggctgcggcagtccgccgggaagggactggagtggattggggcgcatctataacagtggcagcaccaactacaaccccgccctcaagagtcgagtcacatgtcactagacaggtccaagaaccagttctccctgaaattgacttctgtgaaccgcgcggacacggccgtatattattgtgcgaagagattcctatcgatacagtagagacggggggggcgaactggctcgaccctgggggccagggaaccctggtcaccgtctcctcagcctccaccaagggcccatcggtcttccccctggcaccctcctccaagagcacctctgggggcacagcggccctgggctgcctggtcaagggactacttcctatatactgtctgagcgggctggcaaggcgcatag

SEQ ID NO: 791598 - DNA, 700 bp, Homo sapiens
  misc_feature: 34196.UNK.UNK.UNK.pb.heavy.1.raw 34196
cgtatcgcctccctcgcgccatcagacagtatatacacgaccggtgctcgatttaggcactcgcacgttgggttggggagaggagcccagccactggattccgagtgtttccattcgggtgatcagcactgaacacagaggactcaccatcggagttttggctgagctgggttctccttgttggacggtttaaaaggtgtccagtgtgaggtgcgctgatggagtctgaggaggcttagtccagcctgggggggttccagagactctcctgtgcagcctctgggctcaccgtcagcagcaactacatgagttgggtcgcaggctccagggaagggggctggagtgggtctcagtcatttatactggtgatttcacatactacgcagactccgtgaagggccgattcaccatctccagggacaattccaggaacaacggtttatcttcaaatgaacaacctgagaggcgacgacacggccgtctattactgtgcgagacaagtcggcgctcggagtgttattatcgtttgacttctggggccagggaaccctggtcaccgtcgcctccgcctccacaaggggcccatcggtcttcccctggcaccctcctccaagagcacctctggggcacagcggccctgggctgcctggtcaaggactacttcctatatactgtctgagcgggctggcaaggcgcatag

SEQ ID NO: 791599 - DNA, 647 bp, Homo sapiens
  misc_feature: 34201.44.86.H09.1.pb.heavy.1.raw 34201
ctatgcgccttgccagcccgctcagacagtatataggaagtagtccttgaccaggcagcccagggccgctgtgccccagaggtgctcctggagcagggcgccagggggaagaccgatgggccctgggtggaagctgaggagacagtgaccagggtgccacggcccatagattgaaagaccagtctcgcctcgcacagaaataaacggcgtgtccgcggcggtcacggaggtcagtttcagggagaagcggttcatggacgtgtccctcgaaatggtgagacgactcttgagggacggagagtagtacgtcgccccagtataatggatgtcaccaatccactccattccccctccctggggctgccggatccagccccaagaatgatcagaactgatggaaactccagagacagtgcagatgagagacagggttcccgaaggcctcaccagtcctggcccgactcctgcagctgcacctggacaggacccatctgggagctgccaccagcaggaggaaaaaccacaggtgcttcatgttcttgcacaggaggtccttgactctcagaaagcatcccaaacccaagtctatagcactaaatcgagcaccggtcgtgtatatactgtctgatggcgcgaggagcgatacg

SEQ ID NO: 791600 - DNA, 618 bp, Homo sapiens
  misc_feature: 34214.44.23.C01.1.pb.heavy.1.raw 34214
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccacaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791601 - DNA, 711 bp, Homo sapiens
  misc_feature: 34225.44.55.E11.1.pb.heavy.1.raw 34225
ctatgcgcttgccagcgccctcagactagtactgagggaagtagaagtcctgaccagggcagcccagggccgctgtgcccccagaggtgctcgttggaggagggtgccagggggaagaccgatgggcccttggtggaggcggaggccgacgggaccagggttccctggccccagaagtcaaacgaataataaccactccgaggcgccgacttgtctcgcacagtaatagacgccgtgtcgtcgcctctcaggttgttcatttgaagataaaccgtgttcctggattgtccctggagatggtgatcggcccttcacggagtctgcgtagtatgtgaaatcaccagtataaatgactgagacccactcagcccttccctggaagcctggcggacccaaactcatgtagttgctgctgcacggtgagcccagaggctgcacaggagagtcctgggactcccccaggctggactaagccctgcctccagactccatcagccgcacctcacactggacaccttttaaaagtccaacaaggagaacccagctcagccaaaactccatggtgagtcctctgtgttcagtgctgatcaccgaatggaacacctcggaatcccagtgctgggctcctcttccccccaaacccaacgtgcgagtgctaaatcgagcaccggtcgtgtatatactgtctgatggcgcgagggaggcgatacg

SEQ ID NO: 791602 - DNA, 699 bp, Homo sapiens
  misc_feature: 34228.44.27.C05.1.pb.heavy.1.raw 34228
ctatgcgccttgccagcccgctcagacagttatataggaagtagtccttgaccaggcagcccagggccgctgtgctctcggaggtgctcctggagcagggcgccagggggaagaccgatgggcccttggtggaggccgaggagacggtgaccagggttcctggccccaggcgtcgaatgaaccgattttggaaacagatagtctcgcacaaaatacacggccgtgtcctgaggtctcaggctgttcatttgaagagacactgtgttctcggaattgtctctggagatggtgaatcggccctcaacggaatcaccgtagacttgatttcctcatgaaatgacacacctgccacccactccagcccctcgcctgggcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaactccatggtgagtcctctgtgttcagtgatgatcaccgagtggaaacaccggcgacttccagtgctgggctcgtctcccaggccccaaaccttcgatcgcgtctaaatcgagcaccggtcgtgtatatactgtctgatggcgcgagggaggcgatacg

SEQ ID NO: 791603 - DNA, 695 bp, Homo sapiens
  misc_feature: 34242.UNK.UNK.UNK.pb.heavy.1.raw 34242
cgtatcgcctcctcgcgccatcagacagtatatacacgacgtgctcgatttagcagacgtctgaacacacaaagggagctctgggagaggagcccagccgtgagattcccaggagtttccacttggtgatcagcactgagcacagaccaccaaccatggagtttggctaatcttgattttccttgtagttttttagaaggtgtcagtgcgagggcgactggcggagtcggggggggctgtacagccagggcggtctctgagactctcctgtgtagtctcaggattcagtcttagtgattatcacttggcctggtccgtcaggctccagggaaggggcttgagtggatcactttcgtcagaatgaacgttatggtggaagtaaagagtacgccgcgtctgtgaaggaagattcaccgtctcaagggatgactcaacagtgttggccatttacaaatgagcaacctgagaccgacgacacaggcgtctattactgcgccaggcgatcctgggacgtcgatgcatttgatatttggggccaggggacaatggtcaccgtctcttcagcttccacaagggcccatcggtcttcccctggcgccctgctccaggagcacctctggggcacagcggccctgggctgcctggtcaaggactacttcctatatactgtctgagcgggctggcaaggcgcatag

SEQ ID NO: 791604 - DNA, 694 bp, Homo sapiens
  misc_feature: 34245.44.56.F01.1.pb.heavy.1.raw 34245
ctatgcgccttgccagcccgctcagacagtatataggaagtagtccttgaccaggcagccaggccgctgtgcccccagaggtgctcctggagcagggcgccagggggaagaccgatgggccttggtggaagctgaagagacggtgaccattgtcccctggcccaaatatcaaatgcatcgacgtccaggatcgcctggcgcagtaatagacgcctgtgtcgtcggtctcaggttgctcatttgtaatggccaacactgttggagtcatcccttgagacggtgaatcttcccttcacagacgcggcgtactctttacttccaccataacgttcattctgacgaaagtgatccactcaagccccttcctggagcctgacggaccaggccaagtgataatcactaagactgaatcctgagactacacaggagagtctcagagaccgccctggctgtgcaagcccccccccgactccgccagtcgccctcgcactggacaccttctaaaaaaactacaaggaaatcagattagcccaaactccatggtggtggtctgtgctcagtgctgatcaccaagtggaaactcctgggaatctcacggctgggctcctctccagagctcccttgtgtgttcagacgtctgctaatcgagcaccggtcgtgtatatactgtctgatgcgcgagggaggcgatacg

SEQ ID NO: 791605 - DNA, 599 bp, Homo sapiens
  misc_feature: 34246.UNK.UNK.UNK.pb.heavy.1.raw 34246
gaaggctgggcaggctatgcaccctggtccaggtcaaaagctgcggaacccgctagcggccatcttggccactaggggtccgcagattcatattgtcgtctagcatgcacaatgctgcaaaccagcttgcaatgccacagcaagcggccaatctttacgccacgttgaattgtttattacctgtgactggctatggcttgcaacgccactcgtaaaactagtactttgcgttaggggaagtagacaaacccattactccacttcccggaagttcaactcattccaacacgaaataaaagtaactcaacaccccaagcaggctatgtgggggggtgatagggtggattctatttcctatcccatcccctaggatctcaattaagttactgcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcagcgtgtcgg

SEQ ID NO: 791606 - DNA, 712 bp, Homo sapiens
  misc_feature: 34286.UNK.UNK.UNK.pb.heavy.1.raw 34286
cgtatcgcctccctcgcgccatcagacagtatatacacgaccggtgcctcgatttagagtatacatattgggtttgggggggaaggagcccagcactgggattccgaggtgtttccattcggctgatcagcactgaacacagaggactcaccatggagttttgggctgagctgggttctcccttgttggacttttaaaaggtgtccagtgtgaggtgcggctgatggagtactggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcaacatactacgcagactccgtgaagggccgattcaccatctccaggacaattcgcaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatccggtcttccccctggcaccctcctccaagagcacctctggggccacagcggccctgggctgcctggtcaaggactacttcctatatactgtctgagcgggctggcaaggcgcatag

SEQ ID NO: 791607 - DNA, 683 bp, Homo sapiens
  misc_feature: 34315.UNK.UNK.UNK.pb.heavy.1.raw 34315
cgtatcgcctccctcgcgcatcagacagtatacgaccggtgctcgatttagcactcgcacgttgggtttgggggcggagaggagcccagcactgggattccgaggtgtttccattcggtgatcagcactgaacacagaggactcaccatggagttttggctgagctgggttcttgttgacttttaaaggtgtccagtgtgagtgcggctgatggagtctggaggagcttagtccagcctggggggtccagagactccctgtgcagcctctgggctcaccgtcagcagcactacatgagttgggtccgccaggctccagggaaggggctgagtgggtctcagtcatttatactggtgatttcacatactacgcagactcgtgaagggccgattcaccatctccagggacaattccaggaaacacggtttatcttcaaatgaacaacctgagaggcgacgacacggccgtctatactgtgcgagacaagtcggcgctcggagtggttattattcgtttgacttctgggccaggaaccctggtcaccgtcgcctccgcctccaccaaggcccatcggtcttcccctggcaccctcctccaagagcacctctggggcacagcggccctgggctgcctgtcaaggactacttcctatatactgtctgagcggctggcaaggcgcatag

SEQ ID NO: 791608 - DNA, 611 bp, Homo sapiens
  misc_feature: 34316.UNK.UNK.UNK.pb.heavy.1.raw 34316
cccgacacgcttgctagggacttggagctaaggacggacatattgcctttagacagtcgaaggtgacgccttagctaccactgaacgtttaggcgccagatgcggtctgggatgacctaactcgcagcttatcgatgatctactgcacgctcaaccaaccaggtcttgatgcgccgcgataggactgacgggatcgcttacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccggcaaagtactagtttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791609 - DNA, 630 bp, Homo sapiens
  misc_feature: 34320.UNK.UNK.UNK.pb.heavy.1.raw 34320
cgtatcgcctcctcgcgcatcagacagtatatacacgacggtgctcgatttagtactatagacttgggtttgggatgctttctgagagtcaaggacctcctgtgcaagaacatgaagcacctgtggtttttcctcctgctggtggcagctccagatggtcctgtcccaggtgcagctgcaggagtcgggcccaggactggtgaggccttcgggaaccctgtctctcatctggcactgtctctgagtttcatcagttctgatcattctgggctggatccggcagcccccagggaggggaatggagtggattgtgacatcattatactgggcgacgtactactctccgtccctcaagagtcgtctcacatttcgagggacacgtccatgaaccgcttctccctgaaactgacctccgtgaccgcgcggacacggccgtttatttcgtgcgaggcgagactggtctttcaatctatgggcgtggcacctggtcactgtctctcagcttccaccaagggcatcggtcttcccctggcgccctgctccaggagcacctctggggcacagcggcctgggctgcctggtcaaggactacttcctatatactgtctgagcggctggcaaggcgcatag

SEQ ID NO: 791610 - DNA, 612 bp, Homo sapiens
  misc_feature: 34327.44.36.D03.1.pb.heavy.1.raw 34327
ctatgcgccttgccagcccgctcagacagtatataggaagtagtccttgaccaggcagcccagggccgctgtgcccccagaggtgctcctggagcagggcgccagggggaagaccgatgggccctttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctggggggctgacggatccaggctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgatagtatagactgatggcgcgagggaggcgaatacg

SEQ ID NO: 791611 - DNA, 687 bp, Homo sapiens
  misc_feature: 34329.UNK.UNK.UNK.pb.heavy.1.raw 34329
cgtatcgcctccctccgcgccatccagaccagtatatacacgaccggtgctcgatttagtagtggtagatttccgcgggggctttctgagagtcatggacctccctgtgcaagaacatgaagcacctgtggttcttcctcctgctggtggcggctcccaggatgggtcctgtccccagctgcaagctgcaggagtcgggcccaggactggtggaagccttcggagaccctgtccctcaccctgcactggtctctggtggctccatcagcagtaagtagttactactggggctggatccgccagccccccagggaagggggctggagtggatttgggagtatctattatatgggagcacctactacaaacccgtcccctcaagagtcgagtcaccatatcagtagacacgtccaagaaccagttctccctgaaggctgagctctgtgacccccgcggacacggccgtgtattactgtgcgagagtagggcagttcgtcaccaactacttttgaccactgggggccagggaaccctggtcaccgtctcctcagcctccaccaagggcccatcggtcttccccctggcaccctcctccaagagcacctctgggggcacagcggccctgggctggcctggtcaaggactactttcctatatactgtctgagcgggctggcaaggcgcatag

SEQ ID NO: 791612 - DNA, 593 bp, Homo sapiens
  misc_feature: 34337.UNK.UNK.UNK.pb.heavy.1.raw 34337
ctatggccttgccagcccgctcagacagtatataggaagtgtccttgaccaggcagcccagggccgctgtgccccagggtgctcctggagcagggcgccagggggaagaccgatggcccttgtggaagctgaggagacagtgaccaggggccacggcccaagattgaagaccagtctcgcctcgcacagaaataaacggccgtgtccgcggcggtcacggaggtcagtttcaggggaagcggtcatggacgtgtccctcgaaatggtggacgctcttgagggacggagagtgtcgtcgccccccagtataatggatgtcaccatccactccattccctccctgggggctgccggatccagccccaagaatgatcagactgatggaaactccaggacagtgcaggatgaggcagggttcccgaggcctcaccagcctgggccgactcctgcgcgcccctgggacaggaccgggctgccaccgcaggggaaaccacagggctcagctgccaggaggccttgactctcgagccccatccctacacggtcaaatcggcccggcgtgaaacgtctgatggcgcgagggaaggcgaaca

SEQ ID NO: 791613 - DNA, 711 bp, Homo sapiens
  misc_feature: 34346.44.84.H07.1.pb.heavy.1.raw 34346
cgtatcgcctcctcgcgccatcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggatttttcttgtgactattttaaaggtgtccagtgtgaggtggccctgttggagtctgggggaggattggcacagcctgggggtccctgagactctcctgtgcagcctctggcttccccttttaggagctatgccatgacctgggtccgccaggctccagggaaggggctcgagtgggtctcgacaattggcgctagtgcaactgacaacatactacggagagtccgtgaagggccgcttcaccatctccagagacaattccggaaacacactttttctggaaatgaacagcctgagagtcgaagacacggccctttatttctgtgcgaagagggggggggactggatccacagtgggtgggtggttcaactcctgggccagggagccctggtcaccgtcgccgcagcctccaccaagggccatcggtcttcccctggcaccctcctccaagagcacctctgggggcaacagcggccctggctgcctggtcaaggactacttcctatatactgtctgagcgggctggcaaggcgcatag

SEQ ID NO: 791614 - DNA, 717 bp, Homo sapiens
  misc_feature: 34356.44.33.C11.1.pb.heavy.1.raw 34356
ctatgcgccttgccagcccgctcagacagtatataggaagtagtccttgaccaggcagcccagggccgctgtgcccccagaggtgctcttgggaggagggtgccaggggaagaccgatggcccttggtggagctgaggagacgcgaccgtggtcccttggccccaggcgtccataccattggagtagagcatgtcatatctgtatccacgagcccatctctcgcacagtagtagacagcgtgtcctcggctctcaggctattcatttccagatatagtgtgttcttcgaattgtcctggagatggtgaatcggcccttcacggaatctacataatatttattacttccatcaacatataagtgccacccactccagtcctgcctggagcctggcggacccagtgcatgccatgtctgttgaaggtgaatccagacgctacacaggagagtctcagggacctccaggctggaccacgcctccccagactccaccagcttcacctgacactggacatcttaaaagagcaacgaggaaaacccaggtcagccccaaactccatggtgagtcctctgtgttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 791615 - DNA, 609 bp, Homo sapiens
  misc_feature: 34374.UNK.UNK.UNK.pb.heavy.1.raw 34374
gaaggctgggcaggctatgcaccctggtccaggtcaaaagcctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtccttatcgcgcgcatcaagacctggttggttgagcgtgcagtagatcatcgataagctgcgagttaggtcatcccagaccgcatctggcgcctaaacgttcagtggtagctaaggcgtcaccttccgactgtctaaaggcaatatgtcgtccttagctccaagtccctagcaagcgtgtcggg

SEQ ID NO: 791616 - DNA, 698 bp, Homo sapiens
  misc_feature: 34416.UNK.UNK.UNK.pb.heavy.1.raw 34416
cgtatcgcctcctcgcgccatcagacagtatatacacgaccgtgctcgatttagctgcgtcacgatctctcttggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggctggccgcagtaaaaacaaaagttgccagctttatcacagagtacgccgcgtctgtgaaagccagattcaccctctcaagagatgacttcaagaactcattgattctgcgaaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccagagcacctccgagagcacagcggccctgggctgcctggtcaaggactacttcctatatactgtctgagcggctggcaggcgcatag

SEQ ID NO: 791617 - DNA, 695 bp, Homo sapiens
  misc_feature: 34419.44.56.F01.1.pb.heavy.1.raw 34419
cgtatcgcctcctcgcgccatcagacagtatatacacgaccggtgctcgatttagcagacgtctgaacacacaaaggggagctctgggagaggagcccagccgtgagattccaggagtttccacttggtgatcagcactgagcacagaccaccaaccatggagtttgggctaatcttgattttccttgtagtttttttagaaggtgtccagtgcgaggggcgactggcggagtcggggggggctggcacagccaggcggtctctgagactctcctgtgtagtctcaggattcatcttagtgattatcacttggcctgggtcgtcaggctcagggaagggcttgagtggatcactttcgtcagaatgaaacgttatggtggaagtaaagagtacgcgcgtctgtgaaggaagattcaccgtctcagggatgactccaacagtgttggccatttaaaatgagcaacctgagacccgacgacacaggcgtctattactgcgccagcgatcctgggacgtcgatgcatttgatatttggggccagggacaatggtcaccgtctctctcagctccaccaaggcccatcgtcttccccctggcgccctgctccaggagcactctgggggcacagcggccctgggctgcctggtcaagactacttcctatatactgtctgagcgggctggcaaggcgcatag

SEQ ID NO: 791618 - DNA, 708 bp, Homo sapiens
  misc_feature: 34528.44.85.H08.1.pb.heavy.1.raw 34528
cccgctcagacagtatataggaagtagtccttgaccaggcagcccagggccactgtgcccccagaggtgctcttggaggagggtgccaggggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcgggcccttcacggagtctgcatagtatttattacttccatcataccatataagtgccacccactccagcccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaaccagctcagccaaactccatggtgagtcctctgtgttcagtgctgatcaccgaatggaaacaccgccgacttctagtgctgggctcctctcccagagctcccgcgactgagtgatactaaatcgagcaccggtcgtgtatatactgtctgatggccgcgagggaggcgatacg

SEQ ID NO: 791619 - DNA, 709 bp, Homo sapiens
  misc_feature: 34537.44.36.D03.1.pb.heavy.1.raw 34537
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggcctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccggcgtctgtgaaagccagattcaccctctcaagagatgacttcaagaactcattgattctgcgaatgactaacctgaaaaccgaggacacgggcatgtattattgtgttgtgtttatatcaggaactgtccactggggcccagggaaccctggtcaccgtctcctcagcctccaccaagggcccatcggtcttccccctggcgccctgctccaggagcacctccgagagcacagcggccctgggctgcctggtcaaggactacttcctatatactggtctgagcgggctggcaaggcgcatag

SEQ ID NO: 791620 - DNA, 659 bp, Homo sapiens
  misc_feature: 34540.44.86.H09.1.pb.heavy.1.raw 34540
cgtatcgcctccctcgcgccatcagacagtatatacacgaccggtgctcgatttagtgctatagacttgggtttgggggatgctttctgagagtcaaggacctcctgtgcaagaacatgaagcacctgtggttttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcctcaaagagtcgtctcaccatttcgagggacacgtccatgaaccggcttctccctgaaactgacctccgtgaccgccgcggacacggccgtttatttctgtgcgaggcgagactggtctttcaatctatggggccgtggcagccctgggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791621 - DNA, 681 bp, Homo sapiens
  misc_feature: 34563.UNK.UNK.UNK.pb.heavy.1.raw 34563
cgtatcgcctcctcgcgccatcagacagtatatacacgacggtgctcgatttagctgcgtcacgatctctcttgggggagagcggagccccagcccagaattccaggtgttttcatttggtgatcagcactgaacacagaggactcaccatggagttcgggctgagctggttttccttgttgttattttacaaggtgtccagagtgaagtgcagttgggagtcggggagacttggtccagcctggagggtcctgagactctcctgtgtcgcctctggattcaccatcagtgaccactatatggactgggtccgccaggctccaggaagggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgagacacgggcatgtattattgtgttgtgtttatatcaggaactgtccactgggccagggaaccctggtcaccgtctctcagcctcaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 791622 - DNA, 683 bp, Homo sapiens
  misc_feature: 34584.UNK.UNK.UNK.pb.heavy.1.raw 34584
cgtatcgcctccctcgcgccatcagacagtatatacacgacggtgctcgattttgatcacataacaaccacactcctcctctaaagaagcccctggagcacagctcatcaccatggactggacctggcggttcctctttgtggtggcagcagctacaggtgtccagtcccaggtgcagctggtgcagtctgggctgaggtgaagaagcctgggtcctcggtgaaggtctcctgcaaggctctggaggcaccttcttcagctatgcttttatttgggtgcgacaggcccctggacaagggcttgagtggctgggagggatcatccctatctttggtgcatcgaattacgcacagaagtttcaggacagagtcaccattacgcggacgaatccacgagtacagcctacatggagctgagcaggctgagatctgaagacacggccatctatttctgtgcgagagccctcgtcaactttcatagtccctctcatagtcccacacatggaattggttcgacccctggggccagggaacctggtcaccgtctcctcagctccaccaagggcccatcggtcttccccctggcgccctgctccaggagcacctctggggcacagcggccctgggctgcctggtcaaggactacttcctatatactgtctgagcggctggcaaggcgcatag

SEQ ID NO: 791623 - DNA, 689 bp, Homo sapiens
  misc_feature: 34638.44.72.G06.1.pb.heavy.1.raw 34638
ctatgcgccttgccagccgctcagacagtatataggaagtagtccttgaccaggcagccagggccgctgtgctctcggaggtgcttcctggagcagggcgccaggggaagaccgatgggcccttggtggaggctgaggagacggtgaccagggttccctgacccagtagtcaatgagccacccagcgcctcccgcacaataatacacagccgtgtcctcgactctcagaactgttcatttgcagatacagtgagttcttggcgttgtctctggagatggtgaatcggcccttcacagagtccacatagtgtgtctcagttccatctttcttcatgatggccaccccactccagcccttcctggagcctggcggacccagttcatccaataactactaaaggtgaatccagaggctgcacaggagagtctcagggaccccccatgctggaccaagcctcccccagactccaccagttgcacctcacactggacaccttctaaaatagcaacaaggaaaaccccagctcagtccaattccatggtgagtcctctgtgctcagtgctgatcaccaagtggaaaggccttggagtccagggctaaggctctctcttcccctttcccttgcagtcgtagctaaatcgagcaccggtcgtgtatatactgtctgatggcgcgaggaggcgatacg

SEQ ID NO: 791624 - DNA, 703 bp, Homo sapiens
  misc_feature: 34662.44.36.D03.1.pb.heavy.1.raw 34662
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcgtcttccccctggcgccctgctccaggagcacctccgagagcacagcggccctgggctgcctggtcaaggactacttcctatatactgtctgagcgggctggcaaggcgcata

SEQ ID NO: 791625 - DNA, 683 bp, Homo sapiens
  misc_feature: 34791.UNK.UNK.UNK.pb.heavy.1.raw 34791
ctatgcgcctgccagcccgctcagacagtatatagaagtagtccttgaccagcagccagggcgctgtgctctcgagtgctctggagcagggcgccagggggaagaccgatgggccctggtggaggctgaggagacgtgaccagggttcctggccccagtggacagttcctgatataaacacaacacaataatacatgcccgtgtcctcggtttcaggttagtcattcgcagaatcaatgagttcttgaagtcatctcttgagagggtgaatctgctttcacagacgcggcgtactctgtgataaagctggcaactttgtttttactgcggccaagccactccagcccttccctggagcctggcgacccagtccatatagtggtcactgatggtgaatccagaggcgacacaggagagtctcaggaccctccagctggaccaagtctccccggactccaccaactgcacttcactctggacaccttgtaaaataacaacaaggaaaacccgctcagcccgaactccatggtgagtcctctgtgttcagtgctgatcaccaaatgaaaacacctgggaattctggggctgggctccgctctcagagctccccaagagagatcgtgacgcagctaaatcgagcacggtcgtgtatatactgtctgatggcgcgaggaggcgatacg

SEQ ID NO: 791626 - DNA, 629 bp, Homo sapiens
  misc_feature: 34816.UNK.UNK.UNK.pb.heavy.1.raw 34816
cccgacacggcttgctagggacttggagctaaggacgacatattgcctttagacagtcgaaggtgacgccttagctaccactgaacgtttaggcgcccagatgcggtctgggatgacctaactcgcaggcttatcgatgatctactgcacggctcaaccaaccaggtcttgatgcgcgcgataggactgacgggatcgctacagacatttaactcgctagtaacttaattgagatcctaggggatgggataggaaatagaatccacccctatcaccccccccccacatagcctgccttggggtgttgagttttacttttatttcgtgttggaatgagttgaacttccgggaagtggagtaatggtttgtctacttcccctaaaccgcaaagtacagttttacgagtggcgttgcaagccatagccagtcacagggtaataaacaattcaaacgtgggcgtaaagattggccgcttgctgtgggcattgcaagctgggtttgcagcattgtgcatgctaggacgacaatatgaaatctgccgggacgcctagtgggccaagatggccgctagcgggttccgcagcttttgacctgggaccagggtgcatacgcctgcccgcagccttctc

SEQ ID NO: 791627 - DNA, 706 bp, Homo sapiens
  misc_feature: 34826.44.36.D03.1.pb.heavy.1.raw 34826
ctatgcgccttgccagcccgctcagacagtatataggaagtagtccttgaccaggcagcccagggccgctgtgctctcggaggtgctcctgagcagggcgccagggggaagaccgatggggcccttggtggaggctgaggagacggtgaccagggttccctggccccagtggacagttcctgatataaaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagcccttccctggagcctggcggacccccagtccatatagtggtcactgatggtgaaatccagaggcgacacaggagagtctcaggaccctccaggctggaccaagtctcccccggactccaccaactgcacttcactctggacacctgtaaaataacaacaaggaaaacccagctcagcccgaactccatggtgagtcctctgtgtttcagtgctgatcaccaaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 791628 - DNA, 619 bp, Homo sapiens
  misc_feature: 34829.44.23.C01.1.pb.heavy.1.raw 34829
cgtatcgcctccctcgccgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcggaaccctgtctctcatctgcactgtctctggagtttccatcagttctgatcattcttggggctggatcggcagcccccagggagggaatggagtggattggtgacatccattatactgggcgacgtactactctccgtccctcaagagtcgtctcaccatttcgaggacacgtccatgaaccgcttctccctgaaactgacctccgtgaccgccgcggacacggccgtttatttctgtggcgaggcgagactggtcttttcaatctatggggccgtggcaccctggtcactgtctcctcagcttccaccaagggcccatccggtcttccccctggcgccctgctccaggagcacctctgggggcacagcggcctgggctgcctggtcaaggactacttcctatatactgtctgagcgggctggcaaggcgcatag

SEQ ID NO: 791629 - DNA, 702 bp, Homo sapiens
  misc_feature: 34840.44.55.E11.1.pb.heavy.1.raw 34840
cgtatcgcctccctcgcgccatcagacagtatatacacgaccggtgctcgatttagcactcgcacgttgggttggggggagaggagcccagcactgggattccgaggtgtttccattcggtgatcagcactgaacacagaggactcaccatggagtttttggctgagctgggttctccttgttggacttttaaaaggtgtccagtgtgaggtgcggctgatggagtctggaggaggctagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggttatcttcaaatgaacaacctgagaggcgacgacacggccgtctattactgtggcgagacaagtcggcgctcggagttggttattattcgtttgacttctggggccagggaaccctggtcaccgtcgcctccgctccaccaagggccatcggtcttccccctggcacgcctcctcaagagcacctctgggggcacagcggccctgggctgcctggtcaaggactacttcctatatactgtctgagcgggctggcaaggcgcatag

SEQ ID NO: 791630 - DNA, 591 bp, Homo sapiens
  misc_feature: 34886.44.78.H01.1.pb.heavy.1.raw 34886
ctatgcgccttgccagcccgctcagacagtatataggaagtagtccttgaccaggcagcccagggccgctgtgctctcggaggtgctcctggagcagggcgccagggggaagaccgatgggcccttggtgggaggctgaggagacggtgaccagggttccctggccccacaagtcaagccaggtgcttggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccgttaatatcataattgatgaacgtgtatccagaagccgtgcaggagactgtcactgaggccccaggcttcttcacctcagccccagactgcaccagctgtacctgggagtgggaccgtcagtcttcctctcccccaaacccaaactactcacactaaatcgagcaccggtcgtgtatatactgtctgatggcgcgagggaggcgatacg

SEQ ID NO: 791631 - DNA, 699 bp, Homo sapiens
  misc_feature: 34887.44.73.G07.1.pb.heavy.1.raw 34887
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtgagtctggggaggcgtggtccagcctggaggtccctgagactctcctgtgaagcctctggatttagtttcagtagttctggcatgcactgggtccgccaggctccaggcaaggggccggagtggtggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactgggccagggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791632 - DNA, 703 bp, Homo sapiens
  misc_feature: 34892.UNK.UNK.UNK.pb.heavy.1.raw 34892
ctatgcgcccttgccagcccgctcagacagtatataggaagtagtccttgaccaggcagcccagggccgctgtgctctcggaggtgctcctggagcagggcgccagggggaagaccgatgggcccttgtgaggccgaggagacggtgaccagggttccctggccccaggcgtcgaatgaaccgattttggaaacagatagtctcgcacaaaaaatacacggccgttgtcctgaggtctcaggctgttcatttgaagagacactgtgttctcggaattgtctctggagatggtgaatcggccctcacggaaatcaccgtagacttgatttcctccatgaaatgacacacctgccacccactccagcccctcgcctggagcctggcggacccactgcatatccaattatcgaaggtgaatccagaggctgcacaggagagtctcaggacccccctactggggccacgcctccccagactccacgaattgcacctgacacatgacacctcttaagagggcacgaggaaaacccagctcagcccaaactccatggtgagtcctctgtgttcagtggatgatcaccgagtggaaacaccgggacttccagtgctgggctcgtctcccaggctccccaaacccttcgatcgcgtctaatcgagcaccgtcgtgtatattactgtctgatggcgcgagggaggcgatacg

SEQ ID NO: 791633 - DNA, 699 bp, Homo sapiens
  misc_feature: 34894.44.56.F01.1.pb.heavy.1.raw 34894
ctatgcgccttgccagcccgctcagacagtatataggaagtagtccttgaccaggcagcccagggcccgctgtgcccccagaggtgctcctggagcaggcgcagggggaagaccgatgggccttggtggaagctgaagagacggtgaccattgtccctggcccaaatatcaaatgcatcgacgtcccaggatcgcctggcgcagtatagaccgcctgtgtcgtcggtcctcaggttgctcatttgtaaatggccaacactgtggagtcatcccttgagacggtgatctcctcacagacgcgcggtactctttactccacataaacgtttcattctgacgaaagtgatccactcaagcccttccctggagcctgacggaccaggccaagtgataatcactaagactgaatcctgagactacacagagagtctcagagaccgccctggctgtgccaagccccccccgactccgccagtcgcccctcgcactggacaccttctaaaaaaactacaaggaaaatcaagattagcccaaactccatggttggtggtctgtgctcagtgctgataccagtggaaactcctgggaatctcacggctggggctctctcccagagctcccctttggtgtgttcagacgtctgctaaatcgagcaccggtcgtgtatatactgtctgatggcgcgagggaggcgatacg

SEQ ID NO: 791634 - DNA, 680 bp, Homo sapiens
  misc_feature: 34896.44.45.E01.1.pb.heavy.1.raw 34896
atgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttgaattgtctctggagacggagaatcggcccttcacggagtttccatagtattctttacttccatcagaccagatgactgccacccactccagccccttgcctggagcctggcggacccagtgcatggcagagtcactgaaaactgagtccggacgcaacacaggagagtctcagggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791635 - DNA, 645 bp, Homo sapiens
  misc_feature: 34897.44.12.B01.1.pb.heavy.1.raw 34897
ccagcccgctcagacagtatataggaagtagtccttgaccaggcagcccagggccgctgtgccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctccactataatagatactcccaatccactccagcccttccctgggggctggcggatccagccccagtagtaactactactgctgatggagccaccagagacagtgcaggtgagggacaggtctccgaaggcttcaccagtcctgggcccgactcctgcagctgcagctggacaggacccatctggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgaggaggcgatacg

SEQ ID NO: 791636 - DNA, 703 bp, Homo sapiens
  misc_feature: 34900.44.27.C05.1.pb.heavy.1.raw 34900
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggcgtgtatttttgtgcgagactatctgtttccaaaatcggttcattcgacgcctggggccagggaaccctggtcaccgtctcctcggcctccaccaagggcccatcgtcttccccctggcgccctgctccaggagcacctccgagagcacagcggccctgggctgcctggtcaaggactacttcctatatactgtctgagcgggctggcaaggcgccatag

SEQ ID NO: 791637 - DNA, 543 bp, Homo sapiens
  misc_feature: 34903.44.38.D05.1.pb.heavy.1.raw 34903
cgtatcgcctccctcgcgccatcagacagtatatacacgaccggtgctcgatttagtatctgatagttgggtttgggggtcctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaaacagtctgagagccgaggacacggctgtgtattactgtgcaagagccggtgcgggagttcggggagttgcatactactactacggtatggacgtctgggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791638 - DNA, 540 bp, Homo sapiens
  misc_feature: 34939.44.43.D10.1.pb.heavy.1.raw 34939
cgtatcgcctccctcgcgccatcagacagtatatacacgaccggtgctcgatttagactagcagtaaggggctgaggtgaagaagcctggggcctcagtgaagggtctcctgcaaggcttctggatacaccttcaccaattatgatatcaactgggtgcgacacaggccactgacaagggcttgagtggatgggatggatgaacccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcgggaggtggttcgacccctggggccagggaaccctggtcaccgtctcctcagcttccacaggggcccatcgtccttccccctggcgccctgctccaggagcacctctgggggcacagcggccctgggctgctggtcaaggactacttcctatatactgtctgagcgggctggca

SEQ ID NO: 791639 - DNA, 575 bp, Homo sapiens
  misc_feature: 34962.44.57.F02.1.pb.heavy.1.raw 34962
cgtatcgcctccctcgcgccatcagacagtatatacacgaccggtgctcgatttagctcgatatagttgggtttggggctgaggtgaagaagcctggggcctcagtgaaggtttcctgcaaggcttctggatacaccttcaatatttatgctatgcagtggggtgcgccaggcccccggacaaaggcttgagtggatgggatggaatcaacgctggcaatggtgacacaagatattcacagaagtttccagggcagagtcaccattaccagcgacacatccgcgagccacagcctacatggagctgagcagcctgagaatctgaagacacggctgtatattattggtgcgagagaggaaggggaatgactacggtaactacctctattactactacatggacgtcctggggcgaagggaccatggtccaccgtctcctcagcctccaccaagggccatcggtcttccccctggcgccctgctccaggagcacctccgagagcacagcggcccctgggctgcctggtcaaggactacttcctatatactgtctgagcgggctggcaaggcgcatag

SEQ ID NO: 791640 - DNA, 653 bp, Homo sapiens
  misc_feature: 34963.UNK.UNK.UNK.pb.heavy.1.raw 34963
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggcgtgtatatactgtctgtggcgcgagggaggcgatacg

SEQ ID NO: 791641 - DNA, 677 bp, Homo sapiens
  misc_feature: 34996.44.12.B01.1.pb.heavy.1.raw 34996
ctatgcgccttgccagcccgctcagacagtatataggaagtagtcctttgaccaggcagcccagggccgctgtgcccccagaggttgctcttggaggagggtgccagggggaagaaccgatgcggccttggtggaggctgaggagacggtgaccagggttccctggccccagtggtcaaagtagttggtgacgaactgccctactctcgcacagtaatacacggccgtgtccgcgggcggtcacagagctcagcttcagggagaactggttcttggacgtgtctactgatatggtgacttcgaactcttgagggacgggttgtttagtaggtgctcccactataaaagatactcccaattccactccagcccttccctgggggctggcggatccagccccagtagtaactactactgctgatggagccaccagagacagtgcaggtgagggacagggtctccgaaggcttcaccagtcctgggcccgactccgcagctgcagctgggacaggaacccatctgggaagccgccaccagcaggaggaagaaccacaggtgcttcatgttcttgcacaggaggtccatgactctcagaaagcccccgcggaatctacactactaaatcgagcaccggtcgtggtatatactgtctgatggccgcgagggagggcgatacg

SEQ ID NO: 791642 - DNA, 705 bp, Homo sapiens
  misc_feature: 35062.UNK.UNK.UNK.pb.heavy.1.raw 35062
ctatgcgccttgccagcccgctcagacagtatataggaagtagtccttgaccaggcagcccagggccgctgtgccccagaggtgctcttggaggagggtgcagggggaagaccgatggcccttggtggaggcggagggcgacggtgaccagggttccctggccccagaagtcaaacgaataataaccaatccggagcgccgacttgtcttcgcacagtaatagacggccgtgtcgtcgcctctcaggttgttcatttgaagataaaccgtgttcctggaattgtccctggagatggtgaatcggccctttcacggagtctgcgtagtatgtgaaatcaccagtataaatgactgagacccactccagcccttccctggagcctggcggaccaactcatgtagttgctgctgacggtgagcccagaggctgcacaggagagtctctgggaaccccccaggctggactaagcctcctcagactccatcagccgcacctcacactggacaggcttttaaaagtccaacaagggaacccagctcagccaaaaactccatggtgagtcctctgtgttcagtgctgatcaccgaatggaaaacctcggaatccagtgctgggctcctctcccccccaaacccaacgtgcggagtgctaaatcgagcaccggtcgtgtatatactgtctgatggcgcgagggaggcgatacg

SEQ ID NO: 791643 - DNA, 708 bp, Homo sapiens
  misc_feature: 35067.44.36.D03.1.pb.heavy.1.raw 35067
cgtatcgcctccctcgcgcccatcagacagtatatacacgaccggtgctcgatttagctgcgtcacgatctctcttgggagctctggaagcggagccccagccccagaattcccaggtgttttcatttggtgatcagcactgaacacagaggaactcaccatggagttcgggctgagctgggtttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgcccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttggtgtttatatcaggaactgtccactggggccagggaaccctggtcaccgtctcctcagcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 791644 - DNA, 694 bp, Homo sapiens
  misc_feature: 35070.44.36.D03.1.pb.heavy.1.raw 35070
ctatgcgccttgccagcccgctcaggacagtatataggaagtagcccttgaccaggcagcccagggccgctgtgctctcggaggtgctcctggagcaggcgccagggggaaagaccgatggcccctggtggaggctgaggagacggtgaccaggttccctggccccagtggacagttcctgatataaacacaacacaataatacatgcccgtgtcctcgttttcaggttagtcatcgcagaatcaatgagttcttgaagtcatctcttgagagggtgaatctgcttcacagacgcggcgtactctgtgataaagctggcaactttgttttactgcggccaagccactccagccccttccctggagcctggcggacccagtccattagtggtccactgatggtgaatccagagcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctccgctctcagagctcccccaagagagatcgtgacgcagctaaaatcgagcaccggtcgtgttatactgtcgatgcgcgaggaggcgatacg

SEQ ID NO: 791645 - DNA, 654 bp, Homo sapiens
  misc_feature: 35115.UNK.UNK.UNK.pb.heavy.1.raw 35115
ctatgcgccttgccagcccgctcagacagtatataggaagtagtccttgaccaggcagcccagggccgctgtgccccagaggtgctcttgaggagggtgccaggggaagaccgatgggccttggtggaggctgaggagacggtgaccaggttccctggccccagtggtcaaaggtagttggtgacgaactgccctactctcgcacagtaatacacgggcgtgtccgcggcggtcacagagctcagcttcagggagaactggttcttggacgtgtctactgatatggtgactcgactcttgagggacggtttagtaggtgctcccactataatagatactcccaatccactcagcccttccctggggctggcggatccagccccagtagtaactactactgctgatggagccaccagagacagtgcaggtgagggacaggtctccgaaggcttcaccagtcctggcccgactcctgcagctgcagctgggacaggacccatctggggagccgccaccagcaggaggaagaaccacaggtgcttcatgttcttgcacaggaggtccatgactctcagaaagcccccgcggaatctacactactaatcgagcaccgtcgtgtatatactgtctgatggcggcgagggaggcgatacg

SEQ ID NO: 791646 - DNA, 640 bp, Homo sapiens
  misc_feature: 35117.UNK.UNK.UNK.pb.heavy.1.raw 35117
cgtatcgcctcctcgcgccatcagacagtatatacacgaccggtgctcgatttactcgatatagttgggtttgggatgctttctgagagtcaaggacctcctgtgcaagaacatgaagcacctgtgtttttcctcctgctgtggcagctcccagatgggtcctgtccccaggtgcagctgcaggagtcgggcccaggactggtgaggccttcgggaaccctgtctctcatctgcactgtctctggagtttccatcagttctgatcattcttggggctgggatccggcagcccccagggaggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcaatctatggggccgtggcactggtcactgtctcctcagcttccaccaagggcccatcggtcttcccctggccgcctctccaggagcacctctggggcacagcgccctgctgcctggtcaaggatacttcctatatactgtcgagcgggctggcaaggcgcatag

SEQ ID NO: 791647 - DNA, 704 bp, Homo sapiens
  misc_feature: 35119.44.55.E11.1.pb.heavy.1.raw 35119
cgtatcgcctcctcgcgccatcagacagtatatacacgaccggtgctcgatttagcactcgcacgttgggtttggggggggagaggagcccagcactggattcgaggtgtttccattcggtgatcagcactgaacacagaggactcaccatggagttttggctgagctgggttctccttgttggacttttaaaggtgtccagtgtgagtgcggctgatggagtctggagggaggcttagtccagcctggggggcgtcccagagactctcctgtgcagcctctggggctcacgtcagcgagcaactacatgagttgggtccgccaggctccagggaaggggctggagtgggtctcagtcatttatactggtgatttcacatactacgcagactccgtgaagggcgattcaccatctccagggacaattccaggaacacggtttatctcaaatgaacacctgagaggcgacgacacggccgtctattactgtgcgagataagtcggcgctcggagtggttattattcgtttgacttctgggcccagggaaccctggtcaccgtcgcctccgcctccaccaagggcccatcgtcttccccctggcacccctcctccaagagcacctctggggcacaggcggcccctggctggcctggtcaaggactacttcctatatacgtgtctgaggcggctggcaggcgcatag

SEQ ID NO: 791648 - DNA, 697 bp, Homo sapiens
  misc_feature: 35155.44.55.E11.1.pb.heavy.1.raw 35155
ctatgcgccttgccagccgctcagacagtatataggaagtagtccttgaccaggcagccagggccgctgtgccagaggtgctcttggaggagggtgccagggggaagaccgatgggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccgccccttccctggagcctggcggaacccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagcaaaactccatggtgagtcctctgtgttcagtgctgatcaccgaatggaaacacctcgggaatcccagtgctgggctcctctccccccaaacccaacgtgcgagtgctaaatcgagcaccggtcgtgtatatactgttgatgggcgcgagggaggcgatacg

SEQ ID NO: 791649 - DNA, 675 bp, Homo sapiens
  misc_feature: 35156.44.6.A06.1.pb.heavy.1.raw 35156
ctatgcgccttgccagcccgctcagacagtatataggaagtagtccttgaccaggcagcccagggccggctgtgccccagaggtgctcctggagcagggcgccagggggaagaccgatgggcccttggtggaagctgaggtgacaatgaccagggttccctgccccagatctcaaaggctccattgcgagctggggtacggacctctcgcacagtagtagacggccgtgtcgtcggatttcaaagaactcattgtcatggagaactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtaataagtagtggaactggtagtaacttccagaggccgtgcaggaaaggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggagtggtgtcagtagatctaaatcgagcaccggtcgtgtatataactgtctgatggcgcgagggaggcgatacg

SEQ ID NO: 791650 - DNA, 677 bp, Homo sapiens
  misc_feature: 35158.UNK.UNK.UNK.pb.heavy.1.raw 35158
ctatgcgccttgccagcccgctcagacagtatatagaagtatccttgaccaggcagcccagggccgctgtgctctcggaggtgctcctggagcagggcgccagggggaagacgatgggcccttggtggaggctgaggagacggtgaccagggctccctggcccagtagaacgatggggctcgtacaataaatagagagccgagtcctcggcctctcaaattgttcatttgtagatacacggtgttcttggaattgtctctggagacggagaatcggccttcacggagtttccatagtatttctttacttccatcagaccagatgactgccacccactccagccttgcctggagcctggcggaccagtgcatggcagagtcactgaaactgagtccggacgcaacacaggagagtctcagggacgtcccaggctggaccacgcctcccccagactccaccagctgaaacctgacactggacacctcttaaagagcaacgaggaaaacccagctcagcccaaactccatggtgagtcctctgtgttcagtgctgatcaccgaatggaaacaccgccgacttctagtgctgggctcctctcccagccctttccttactgactcactaaatcgagcaccgtcgtgtatatactgtctgatggcgcgagggaggcgattacg

SEQ ID NO: 791651 - DNA, 717 bp, Homo sapiens
  misc_feature: 35159.44.39.D06.1.pb.heavy.1.raw 35159
cgtatcgcctccctcgcgccatcagacagtatataccacgaccggtgctcgatttagtgacatctcgcagttctttggggagagacgagcccagcactgaagtcgccggtgtttccattcggtgatcatcactgaacacagaggactcaccatggagtttgggctgagctgggttttcctcgttgctcttttaagaggtgtccagtgtcaggagcacttggtggagtctggggaggcgtggtccagccggaggtccctgagactctcctgtgtagcctctggttctcattcgatagatttggtttgcactggtccgccaggctccagcaaggggccggagtgggtggcagtcatctccgacgatggaagtgagaagtattactgcagactccgtgaagggccgattcaccatctccagagacaattccaagaatatgctgtatttgcaaatgaacagcgtgagagttgacgacacgtctgtttattactgtgcgaggggacctccaaggaaacggttcggggaatcataaacactactatttgatggatgtctggggcaggggacgtcggtcaccgtctcctcagcttccaccaagggcccatcgtcttccccctggcgccctgctccaggagcacctctggggcacagcggccctgggctgcctggtcaaggactacttcctatatactgtctgagcgggctggcaaggcgcatag

SEQ ID NO: 791652 - DNA, 711 bp, Homo sapiens
  misc_feature: 35173.44.27.C05.1.pb.heavy.1.raw 35173
cgtatcgcctccctcgcgccatcagacagtatataccacgaccggtgctcgatttagacgcgatcgaagggtttggggctgggagacgaggcccagcactgaagtcggccggtgtttccactccggtgatcatcactgaacaccagaggacttcaccatggagtttgggctgagctgggttttcctcgttgccctcttaagaggtgtcatgtgtcaggtgcaattcgtgagtctgggggaggcgtggccagtagggggggtccctgagactcctcctgtgcagcctctggattcaccttcgataattggaatatgcagtggtccgccaggctccaggcgagggggctggagtgggtggcaggtgtgtcatttcatggaggaaatcaagtctacggtgattccgtgaaggccgattcaccatctccagagaacaattccgagaacacagtgtctcttcaaatgaacagccctgagacctcaggacacgccgtgtatttttgtgcgagactatctgtttccaaaatgcggttcattcgacgccctggggccagggaaccctggtcagccgtctcctcggctccaccaagggcccatcggtcttccccctggcgccctgctccaggagcacctccgagagcagcagcggccctgggctgcctggtcaaggactacttcctatatactgtctgagcgggctggcaaggcgcatag

SEQ ID NO: 791653 - DNA, 651 bp, Homo sapiens
  misc_feature: 35175.44.23.C01.1.pb.heavy.1.raw 35175
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcaccgtggacaggacccatcgggagctgccaccagcaggaggaaaaaccacaggtgcttcatgttcttgcacaggaggtccttgactctcagaaaggcccccaatccctaatcacgtgtactaaatcgagcaccggtcgtgtatatacctgtctgatggcgcgaggaggcgatacg

SEQ ID NO: 791654 - DNA, 713 bp, Homo sapiens
  misc_feature: 35176.44.55.E11.1.pb.heavy.1.raw 35176
cgtatcgcctccctcgcgccatcagaacacagtatatacacgaccggtgctcgatttagcactcgcacgttgggtttggggagaggagcccagcactgggattccgaggtgtttccattcggtgatcagcactgaacacagaggactcaccatgggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccaggggacaattccaggaacacggttttatcttcaaatgaacaacctgaggaggcgacgacaccggccgtctattactgtgcgagacaagtcggcgctcggagtggttattattcgtttggacttctggggcccagggaaccctggtcaccgtcgcctccgcctccaccaagggcccatcggtcttccccctggcaccctctccaaggagcacctctggggcacaggcggccctggctgcctggtcaaggactacttccctattactgtctgagcgggctggcaaggccgcatag

SEQ ID NO: 791655 - DNA, 708 bp, Homo sapiens
  misc_feature: 35194.44.27.C05.1.pb.heavy.1.raw 35194
cgtatcgcctccctcgcgccatcagacagtatatacacgaccggtgctcgatttagacgcgatcgaaggtttgggagccctggaagacgagcccagcactggaagttcgccggtggtttccactcggtgatcattcactgaacacagagggactcaccatggagtttgggctgagctgggttttcctcgtttgccctcttaagaggtgtcatgtgtcaggtgcaattcgtggagtctggggaaggcgtggccccagtagggggtccctgagactctcctgtgcagcctctggattcaccttcgataattggaatatgcagtgggtccgccaggctccaggcgaggctggaggtgggtggcaggtgtgtcaatttcatggagggaaatcaaggtctacggtgattccgttgaggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaaggcccatcgtcttcccctggcgccctgctccaggagcacctccgagagcacagcggccctgggctgcctggtcaaggactacttcctatatactgtctgagcgggctggcaaggcgcatag

SEQ ID NO: 791656 - DNA, 725 bp, Homo sapiens
  misc_feature: 35197.UNK.UNK.UNK.pb.heavy.1.raw 35197
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcagcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccacagctgcacctgacactggacacctctaaaagagcaacgaggaaaacccaagctcagcccaaactccatggtgagtcctctgtgttcagtgctgatcaccgaatggaaaacaccgccgacttctagtgctgggctcctctcccagagctccccgcgactgagtgatactaaatcggagcaccggtcgtgtatatactgtctgatggcgcgagggaggcgatacg

SEQ ID NO: 791657 - DNA, 672 bp, Homo sapiens
  misc_feature: 35201.44.35.D02.1.pb.heavy.1.raw 35201
cgtatcgcctcctcgcgccatcagacagtatatacacgaccggtgctcgatttagcacacgatagttgggtttgggatactttctgagactcatggccctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctgggccagggaaccctggtcaccgtctcctcagcctccaccaagggcccatcggtcttccccctggcacctcctccaagagcacctctgggggcacagcggccctggctgctggtcaaggactacttcctatatactgtctgagcgggctggcaaggcgcatag

SEQ ID NO: 791658 - DNA, 706 bp, Homo sapiens
  misc_feature: 35206.44.55.E11.1.pb.heavy.1.raw 35206
cgtatcgcctccctcgcgccatcagacagtatatacacgaccggtgctcgatttagcactcgcacgttgggtttgggggggagaggagcccagcactgggattccgagtgtttccattcgtgatcagcactgaacacagaggactcaccatggagttttggctgagctgggttctccttgttggactttaaaaggtgtccagtgtgaggtgcggctgatggagtctggaggaggcttagtccagcctggggggcctcccagagactctcctgtgcagcctctgggctcaccgtcagcagcaactacatgagttgggtccgccaggctccagggaaggggctggagtgggtctcagtcatttatactggtgatttcacatactaccgcagactccgtgaagggccgattcaccatctccagggacaattccaggaacacggtttatcttcaaatgaacaacctgagaggcgacgacacggccgtctatactgtgcgagacaagtcgcgctcggagtggttattattcgtttgacttctggggccagggaaccctggtcaccgtcgcctccgcctccaccaagggcccatcggtcttcccccctggcaccctcctccaaggcacctctggggggcacagcggccctgggctgcctggtcaagggactacttccctatatactgtctgagcggctggcaaggcgcatag

SEQ ID NO: 791659 - DNA, 624 bp, Homo sapiens
  misc_feature: 35241.UNK.UNK.UNK.pb.heavy.1.raw 35241
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggcccccagacgtccataccgtagtagtagtatgcaactccccgaactcccggcaccggctcttgcacagtaatacacagccgtgtcctcggctctcagacctgttcattgcagatacagcgtgttctggccgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagagggctgcacaggagagtctcagggaccccccaggctgaactaagcctccccggaactccaccagctgcacctcacactggacaccttttaaaaatagcaacaaggaaacccagctatcagatactaaatcgagcccaccggtcgtgtatatactgtctgatggcgcgagggaggcgatacg

SEQ ID NO: 791660 - DNA, 728 bp, Homo sapiens
  misc_feature: 35266.44.67.G01.1.pb.heavy.1.raw 35266
ctatgcgccttgccagcccgctcagacagtatataggaagtagtccttgaccaggcagcccagggccgctgtgcccccagaggtgctcttggaggagggtgccagggggaagaccgatgggcccttggtggaggcggagcgacggtgaccagggttccctggccccagaagtcaaacgaattaataacgcactccgagcgcgcacttgtctcgcacagtaatagacggccgtgtcgtcgccctctcaggttgttcatttgaagataaaccgtgtcctggattgtccctggagatgggtggaatcggcccttcacggagtctgcgtagtatgtgaaatcaccagtaataaatgagctgagaccccactccagccccttccctggagcctggcggacccaactcatgtagttgctgctgacggtgaggcccagaggctgcacaggagagtctctgggaccccccaggctggactaagcctgccctccagactgccagtcagccgcagcctcacactggacaccttttaaaagtccaacaaggagaacccagctcagccagaaaactccatggtggagtcctctgtgttcagtgctggatcacgaatggaaaacaccctcggaatcccagtgctgggctcctctcccccccaaaacgccaatatgtatactctaaatcgagcaccggtcgtgtatgatactgtctgatgggccgagggaggcgatgtacga

SEQ ID NO: 791661 - DNA, 710 bp, Homo sapiens
  misc_feature: 35286.44.27.C05.1.pb.heavy.1.raw 35286
cgtatcgcctccctcgcgccatcagacagtatatacacgaccggtgctcgatttagacgcgatcgaagggtttggggcctggagacgagcccagcactggaagtcgccggtgtttccactccggtgatcatcactgaacacagaggactcaccatggagtttgggctgagctgggttttcctcgttgccctcttaagaggtgtcatgtgtcaggtgcaattcgtgagtctgggggaggcgtggccccagtagggggggtccctgagactctcctgtgcagcctctggattcaccttcgataattggaatatgcagtgggtcccgccaggcctccaggcgaggggctggagtgggtggccaggtgtgtcatttcatggaggaaatcaagtctacggtgattccgttgagggccgattcaccatctccagagacaattccgagaacacagtgtctcttcaaatgaacagcctgagacctcaggacacggcccgtgtatttttgtgcgagactatctgtttccaaaatcggttcattcgacgcctggggccagggaaccctggtcaccgtctcctcggcctccaccaagggcccatcggtctttccccctggcgccctgctccaggagcacctccgagagcacagcggccctgggctgcctggtcaaggactacttcctatatactgtctgagcgggctggcaaggcgcatag

SEQ ID NO: 791662 - DNA, 650 bp, Homo sapiens
  misc_feature: 35340.44.38.D05.1.pb.heavy.1.raw 35340
cgtatcgcctccctcgcgccatcagacagtatatacacgaccggtgctcgatttagtatctgatagttggtttggggaagaggaagactgacggtcctcccaggagttcaggtgctgggcaccttggcacgggggaggtgtgtcacaagatttggcgctctggcacccgtggcatgggggaggcttagttcagcctggaggtcctgagactctcctgtgcagccctctggattcaccttcagtagctactgatgcactggtcgccaagcctccagggaggggctggtgggtctcacgtattaatagtgatgggagtagcacaagctacgcggactcccgtgaaaggcgattcaccatcctccagagacagacgccaagaacacgctgtaatctgcaaatgaacagtctgagagccaggacacggctgtgtattactgtgcaagagccggtgcggagttcgggagttgcatactactactacggtatgacgtctgggccaaggaccacggtcaccgtctcctcagcttccaccaagggcccatcgtcttccgcctgggcgcctgctgcaggagcacctctgggggcacagcgccctgggctgccggtcaaggactacttcctatactggtctgggggtgggcaaggcgcta

SEQ ID NO: 791663 - DNA, 685 bp, Homo sapiens
  misc_feature: 35341.44.27.C05.1.pb.heavy.1.raw 35341
cgtatcgcctccctcgcgccatcagacagtatatacacgaccggtgctcgatttagacgcgatcgaagggtttggggcctgggagacgagccagcactgaagtcgccggtggtttccactcggtgatcatcactgaacacagaggactcaccatggagtttgggctgagctgggtttcctcgttgccctcttagaggtgtcatgtgtcaggtgcaattcgtgagtctggggagcgtggcccagtaggggtcctgagactctctgtgagcctctggattcaccttcgataattggaatatgcagtgggtccgccaggctccaggcgagggctggagtggtggcaggtgtgtcatttcatggaggaaatccaagtctacggtgattccgttgagggcgattcaccatctccagagacaattcgagaacacagtgtctcttcaaatgaacagcctgagacctcaggacacggccgtgtatttttgtgcgagactatctgtttccaaaatcggttcattcgacgctgggccagggaaccctggtcaccgtctctcggcctccaccaagggccatcggtcttccccctggcgccctgctccaggagcacctccgagagcacagcgccctgggctgcctggtcaaggactacttcctatatactgtctgagcgggctggcaaggcgcatag

SEQ ID NO: 791664 - DNA, 677 bp, Homo sapiens
  misc_feature: 35342.44.35.D02.1.pb.heavy.1.raw 35342
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatcccaaaccaactatcgtgtgctaaatcgagcaccggtcgtgtatatactgtctgatggcgcgagggaggcgatacg

SEQ ID NO: 791665 - DNA, 606 bp, Homo sapiens
  misc_feature: 35387.UNK.UNK.UNK.pb.heavy.1.raw 35387
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttggcaagccatagccagtcacaggtaataaacaattcaacgtggcgtaaagattggccgcttgctgtgggcattgcaagctgggtttgcagcattgtgcatgctagacgacaatatgaatctgcgggaccctagtggccagatggccgctagcgggttccgcagcttttgacctggaccagggtgcatagcctgcccagccttc

SEQ ID NO: 791666 - DNA, 724 bp, Homo sapiens
  misc_feature: 35388.UNK.UNK.UNK.pb.heavy.1.raw 35388
ctatgcgcctgcagcccgctccagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtgggacagttcctgatataaacacaacacaataatacatgcccgtgtcctcggttttcaggttagtcattcgcagaatcaatgagttcttgaagtcatcctttgagagggtgaatctggctttcacagacgcggcgtactctgtgataaagctggcaactttgtttttactgcggccaagccactccagcccctccctggagcctggcggaccagtccatatagtggtcactgatggtgaatccagagcggacacagagagtctcagggacctccaggctggaccaagtctccccgactccaccaactgcacttcactctggacaccaatgtaaaataacacaaggaaaggcccagctcagcccgaactccatggtgagtcttctgtgttcagtggctgatcacaaatgaaaacacctgggaattctggggctgggggctccgctcgttcagagctcccttaggaggagacgcggaaaaatcggccgacggtcgtagctaatcgagactagcaacgggtcgtgatatactgtctgatggcgcggaggaggcgatacg

SEQ ID NO: 791667 - DNA, 695 bp, Homo sapiens
  misc_feature: 35389.UNK.UNK.UNK.pb.heavy.1.raw 35389
cgtatcgcctccctcgcgccatcagacagtatatacacgacctgtgctcgatttagtgtgagtagtttgggtttggggagctctgggagaggagccccagccttggattccaggtgttttcattcagtgatcaggactgaacacaggaggactcaccatggagtttgggctgagctggattttccttgctgctattttaaaaggtgtccagtgtgaggtgcagttggtggagtctggggggaggttttggtaaaagcctggggagtcccttagactctcctgtgcagcctctggattcactttcagtaacgcctggatgacctgggtccgcaggctccaggaaggggctggagtgggtcggccgtattagaaccaaagctgacggtgggacagcagactacgcctgcacccgtgaaaggcagattcaccatctcaaagagatgattcaaaagatacggtgtctctgcagatgaacagcctgaacaccgaggacacagccgtctattactgtctgggatggtttcattcggccagggaaccctggtcaccgtctcctcagcctccaccaagggccatcggtcttccccctggcgccctgctccaggagcacctccgagagcacagcggccctgggctgcctggtcaaggactactttcctatatactgtctgagcgggctggcaaggcgcatagat

SEQ ID NO: 791668 - DNA, 632 bp, Homo sapiens
  misc_feature: 35398.UNK.UNK.UNK.pb.heavy.1.raw 35398
cgtatcgcctcccttcgcgccatcagacagtatatacacgacggtgctcgatttagtacacgtgattagggattggggcagggtgaacacctgtgtttttcctcctgctggtggcagcctcccagatgggtcctgtcccaggtgcagctgcaggagtcgggccggcaggactggtgaggccttcgggaaccctgtctctcatctgcactgtctctggagtttccatcagttctgatcattcttggggctggatccggccagcccccagggaggggaatggagtggattggtgacatccattatactggggcgacgtactactctccgtccctcaaggagtcgtctcaccatttcgagggacacgtccatgaaccgcttctcctgaaactgacctccgtgaccgccgcggacacggccgtttatttctgtgcgaggcgagactgggtctttcaatctatggggccgtggcaccctggtcactgtctcctcagcttcccaccaaggggccccatcggctcttcccctggcgccctgctccaggagcacctctgggggcacagcggccctgggctgcctggtcaaggactaacttgcctatatactgtctgagggcggcctggcaaggcgcatag

SEQ ID NO: 791669 - DNA, 607 bp, Homo sapiens
  misc_feature: 35490.UNK.UNK.UNK.pb.heavy.1.raw 35490
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791670 - DNA, 713 bp, Homo sapiens
  misc_feature: 35532.UNK.UNK.UNK.pb.heavy.1.raw 35532
cgtatcgcctccctcgcgccatcagacagtaatataccacgaccgggtgctccgatttagtagctctatcagggggagcatccacataacaaccacattcctccgccctaaagaagccccctgggagcacagctcatcaccatggactggacctggaggttcctctttgtggtggcgcagcaacaggtgtccagtccctggtgcaactggtggcagtctgggactagaatgccgcaaccttggtcctcggtgacccttttcctgcacggcctctggaagtactacagttccactacttataccatcaactgggtgcgccaggccccctggacaagggcttgagtggatgggtggaatcatccctctttttggctcactcacctacgcacgagacttccggggcaggaattacgattaccggcgacaagtccacagacacagtctccatgacaatggttctttgaaatccgacgaacacggcccgtctactactgtgcgagagggtccgtaccccagctcgcatggagcctttgagatctgggggcagggaacccctcggtcattgtcacctcagcttccaccaagggccccatcggtcttcccctggcgccctgctccaggagccacctctggggcaacagcggccctggggctgcctggtcaaggactacttcctatatactgtgctgagcggctggcaaggcgcggatagc

SEQ ID NO: 791671 - DNA, 649 bp, Homo sapiens
  misc_feature: 35536.44.86.H09.1.pb.heavy.1.raw 35536
cgtatcgcctccctcgcgccatcagacagtatatacacgaccggtgctcgatttagtgctatagacttgggtttgggggatgctttctgagagtcaaggacctcctgtgcaagaacatgaagcacctgtggttttcctctgctggtggcagctcccagatgggtccctgtcccaggtgcagctgcaggagtcgggcccaggactggtgaggccttcggggaaccctgtctctcatctgcactgtctctggagtttccatcagttctgatcattcttggggctggatccggcagcccccaggagggaatggagtggattggtgacatccattatactgggcgacgtactactctccgtccctcaagagtcgtctcaccattcgagggacacgtccatgaaccgcttctccctgaaactgacctccgtgacccgccgcggacacggcgttatttctgtgcgaggcgagactggtctttcatctatggggccgtggcaccctggtcactgtctcctcagcttccaccaagggcccatcggtcttcccctggcgccctgctccaggagcacctctggggcacagcggccctgggctgcctggtcaaggactacttcctatataactgtctgagcgggctgcaaggcgcaatag

SEQ ID NO: 791672 - DNA, 703 bp, Homo sapiens
  misc_feature: 35540.44.36.D03.1.pb.heavy.1.raw 35540
cgtatcgcctccctcgcgccatcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcacccctctcaagagatgacttcaagaactcattgattctgcgaatgactaacctgaaaccgaggacacgggcatgtattattgtgtttgtgtttatatcaggaactgtccactgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaagcgcatag

SEQ ID NO: 791673 - DNA, 685 bp, Homo sapiens
  misc_feature: 35544.44.55.E11.1.pb.heavy.1.raw 35544
cgtatcgcctccctcgcgccatcagacagtatatacacgaccggtgctcgatttagcactcgcacgttgggttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctggggcacagcggccctgggctgcctggtcaaggactgacgggctggcaaggcgcatag

SEQ ID NO: 791674 - DNA, 693 bp, Homo sapiens
  misc_feature: 35557.44.72.G06.1.pb.heavy.1.raw 35557
ctatgcgccttgccagcccgctcagacagtatatagggaagtagtccttgacccaggcagcccagggccgctgtgctctcggaggtgctcctggagcaagggcgccagggggaagaccgatgggcccttggtggaggctgagggagacggtgaccagggttccctgaccccagtagtcaatgaagccacccagcgcctcccgcaacaataatacacagccgtgtcctcgactctcagactgtcattgcagatacagtgagttcttggcgttgtctctggagatggtgaatcgcccttcacagaagccacatagtgtgtctcagttcccatctttcttcatgatggcacccactccagccccttcctggagcctggcggacccagttcatccaataactactaaaggtgaatccagaggctgcacaggagagtctcagggaccccccaggctggaccaagcctcccccagactccaccagttgcactcaacactggacaccttctaaatagcaacaaggaaacccagctcagtcccaattccatggtgagtcctctgtgctcagtgctgatcaccaagtggaaaggccttggagtccagggctaaggctccctctctcccctttccttgcagtcgtagctaaatcgagcaccggtcgtgtatatactgtctgatggcgcgagggaggcgatacg

SEQ ID NO: 791675 - DNA, 662 bp, Homo sapiens
  misc_feature: 35573.44.12.B01.1.pb.heavy.1.raw 35573
ctatgcgccttgccaagcccgctcagacaggtatataggaagtagtccttgaccagggcagcccagggccgctgtgcccccagaggtgctcttggaggaggtgccagggggaagacgatgggcccttggtggaggctgaggaggacggtgaccaggttccctggccccagtggtcaaaagtagttggtgacgaactgccctactctcgcacagtaatacacggccgtgtccgcggcggtcacagagctcagcttcaggagaactggttcttggacgatgtctactgatatggtgactcgactcattgagggaccgggttgtagtaggtgctccactataatagatactcccaatccacccagccccttccctgggggctggcggatccagcgccagtagaactactactgctgatggagccaccagagacagtgcgggcgtgagggacaggcccgaaggcttcaccagcctggcccgactcctgcagctgcagcgggacaggaccatctggagccgccaccagcaggaggaagaaccacagtgctttcatgttcttgcacaggaggtccatgactctcagaaagcccccgcggaatctacactactaaatcgagcaccggtcgtgtatatactgtctgattggcgcgagggagggcgatacg

SEQ ID NO: 791676 - DNA, 675 bp, Homo sapiens
  misc_feature: 35583.44.6.A06.1.pb.heavy.1.raw 35583
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 791677 - DNA, 715 bp, Homo sapiens
  misc_feature: 35611.44.62.F07.1.pb.heavy.1.raw 35611
ctatgcgccttgccagcccgctcagacagtatataggaagtagtccttgaccaggcagcccaggccgctgtgctctcggaggtgctcctggagcagggcgccagggggaagacgatgggccttggtggaggctgaagagacggtcaccactgtcccccggccccaagtactaaaggtgtcatggggggtcaccgtggtccctggctttcaaacagtaatagacgcctgtgtcctcgggtctcaggtttttcatttggagaaacatttgtcctgcgaattgtccctggaaatggtgaagcggcccttcacggagtctccgtagaaagtgacaccaccagctccgatacttgagacccactccagtccctccctggagcccgggcggacccaggtcatgccataggcactaaaggtgaatcagaaggcccccgcacaggagagggtcagggacctccccaggccgaatcaggccccccagacctccaacaactgccacttcacacacgacaccctttaaaaaagccacaagaaaaaggcagctcagcccaaactccatggagacttctctctgtttcggtcctggtcaccaaatgaagacacctgaaaatcccagggctgggctcctctctcagagctcccctttcctttatgcgactactaaatcgagcaccggtcgtgtatattactgtctgatggcgcgagggagggcgatacg

SEQ ID NO: 791678 - DNA, 614 bp, Homo sapiens
  misc_feature: 35633.44.27.C05.1.pb.heavy.1.raw 35633
cgtatcgcctcccttcgcgccatcagacagtatatacacgaccggtgctcgatttagacgcgatcgaagggtttgggctgagctgggtttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 791679 - DNA, 693 bp, Homo sapiens
  misc_feature: 35665.44.74.G08.1.pb.heavy.1.raw 35665
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatcttcaaaggctccatgcgaggctggggtacggacctctcgcacagtagtagaacggccgtgtcgtcggatttcaaagaactcattgtcatggagactgtgtctgtggacttgtccgcggtaatcgtaatctgccccggaagtctcgtgcgtaggtgagtgagccaaaaaagagggatgattccacccatccaccaagcccttgtccaggggcctgggcgcaccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctcccctgatagagctactaaatcgagcaccggtcgtgtatatactgtctgatggccgaggaggcgatacg

SEQ ID NO: 791680 - DNA, 670 bp, Homo sapiens
  misc_feature: 35708.44.6.A06.1.pb.heavy.1.raw 35708
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtcctggtgcaactggtgcagtctgggactagaatgccgcaaccttggtcctcggtgacctttcctgcacggcctctggaagtactaccagttccactacttataccatcaactgggtgcgccaggcccctggacaagggctgagtggatgggtggaatcatccctctttttggctcactcacctacgcacgagacttccgggcagaattacgattaccgcggacaagtccacagacacagtctccatgacaatgagttctttgaaatccgacgacacggccgtctactactgtgcgagaggtccgtacccagcttcgcatggagcctttgagatctggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791681 - DNA, 710 bp, Homo sapiens
  misc_feature: 35781.UNK.UNK.UNK.pb.heavy.1.raw 35781
cgtatcgcctccctcgcgccatcagacagtatatacacgaccggttgctcgatttagctgcggtcacgatctctcttggggagctctgagagcggagccccagccccagaatttcccaaggtgttttcatttggtgatcagcactgaacacagaggactcaccatggagttcgggctgagctgggttttccttgttgttattttacaaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791682 - DNA, 725 bp, Homo sapiens
  misc_feature: 35793.44.86.H09.1.pb.heavy.1.raw 35793
cgtatcgcctccctcgcgccatcagacagtatatacacgaccggtgctcgatttagtgctatagacttgggttggggagctctgggagaggagcccagcaccagaagtcggcggtggtttccagtcggtgatcagcaccgaacacagaggactcaccatggagtttgggctgacctggttttcctcgttgctcttttaagaggtgtccagtgtcaggtgaagctggtggagtctggggaggcgtggtcagcctgggaggtccctgagactctcctgtgtagcgtctgtattcaccttcaacagacatggcatgcactgggtccgccaggctccaggcaagggactggagtgggtggcacttatatggtatgatggaagtaataaatattatgtagattccgtgaaggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgctggtcaaggactacttcctatatactgtctgagcgggctggcaaggcgcatag

SEQ ID NO: 791683 - DNA, 623 bp, Homo sapiens
  misc_feature: 35820.44.23.C01.1.pb.heavy.1.raw 35820
ctattgcgccttgccagcccgctcagacagtatataggaaagtagtccttgaccaggcagcccagggccgctgtgcccccagaggtgcttcctggagcagggcgccagggggaagaccgatgggcccttggtggaagctgagagacagtgaccaggggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 791684 - DNA, 666 bp, Homo sapiens
  misc_feature: 35822.44.38.D05.1.pb.heavy.1.raw 35822
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggccttcacggagtccgcgtagcttgtgctactcccatcactattaatacgtgagaccacaccagccccttcctggagcttggcggacccagtgcatccagtagctactgaaggtgaatccagaggctgcacaggagagtctcagggacccccccaggctgaactaagcctcccccatgcccacggtgcccagagcccaaatcttgtgacacacctcccccgtgcccaaggtgcccagcacctgaactcctggaggaccgtcagtcttcctcttcccccaaacccaactatcagatactaaatcgagcaccggtcgtgtatatactgtctgatggcgcgagggaggcgatacg

SEQ ID NO: 791685 - DNA, 721 bp, Homo sapiens
  misc_feature: 35832.UNK.UNK.UNK.pb.heavy.1.raw 35832
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtgtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctgagatggtgaatcggcccttcacggaatctacataatatttattacttccatcataccatataagtgccacccactcagtcccttgcctggagcctggcggaccagtgcatgccatgtctgttgaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctccagagctccccaaaccaacgagctcactctaaatcgagcacggtcgtgtatatactgtctgatggcgcgagggaggcgatacg

SEQ ID NO: 791686 - DNA, 696 bp, Homo sapiens
  misc_feature: 35849.44.27.C05.1.pb.heavy.1.raw 35849
cgtatcgcctccctcgcgccatcagacagtatatacacgaccggtgctcgattagacgcgatcgaagggtttggggctgggagacgagcccagcactggaagtcgccggtgtttccactcggtgatcatcactgaacacagaggactcaccatggagtttgggctgagctgggtttcctcgttgcctcttaagaggtgtcatgtgtcaggtgcaattcgtggagtctggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctccaccaagggccatcggtcttcccctggcgccctgctccaggagcacctccgagagcacagcggccctgggctgcctggtcaaggactacttcctatatactgtctgagcgggctggcaaggcgcatag

SEQ ID NO: 791687 - DNA, 715 bp, Homo sapiens
  misc_feature: 35910.44.56.F01.1.pb.heavy.1.raw 35910
ctatgcgccttgccagcccgctcagacagtatataggaagtagtccttgaccaggcagcccagggccgctgtgcccccagaggtgctcctggagcagggcggccagggggaagaccgatgggcccttggtggaagcctgaagagacggtgaccattgtcccctggccccaaatatcaaatgcatcgacgtcccaggatcggcctggcgcagtaatagacgcctgtgtcgtcggtctcaggttgctcatttgtaaatggccaacactgttggagtcatcccttgagaccggtgaatcttcccttcacagacgcggcgtactctttacttccaccataacgtttcattctgacgaaagtgatccactcaagccccttccctggagcctgacggacccaggccaagtgataatcactaaagactgaatcctgagactacacaggagagtctcagagaccgccctggctgtgccaagcccccccgactccgccagtcgcccctcgcactggacaccttctaaaaaaaactacaaggaaaatccaagattagcccaaactccatggttggtggttctgtgctcagtgctgatcaccaagtggaaactcctggaatctcacggctggggctcctctcccagcccctttgtgtgttcagacgtctgctaaatcgagcaccggtcgtgtatatactgtctgatggcgcgagggaggcgatacg

SEQ ID NO: 791688 - DNA, 678 bp, Homo sapiens
  misc_feature: 35935.UNK.UNK.UNK.pb.heavy.1.raw 35935
cgtatcgcctccctcgcgccatcagacagtatatacacgaccggtgctccgatttagtgtcgtcgcaagagagaggagcccagccctggggactgaacagagagaactcaccatggagtttgggctgagcctggctttttcttgtggctgttttaaaaggtgtccagtgtgaagtgcagctgttggagtcggggggaggcttggtacagccgggggggtcctgacactctcctgtgcagcctctggattcgcctttaatacctatgccatgatctgggtccgtcaggcccagggaaggggctggagtgggtctcatccattactggtggtagtgccacaaatgtcgcagactccgtgaagggccgcttcatcgtctccagggacaaattccaaagaatacggtgtttctgcagatgaagagcctgcgagtggacgacacgggccctttattactgtgccagagggtcgcagaagttacaacaatacaagtatttactactacatggacgtctgggcaaagggaccccggtcaccgtctcctcagcctccaccaagggcccatcggtcttccccctggcacctcctccaagagcacctctgggggcacagcggcccctgggctgcctggtcaaggactacttcctatatactgtctgagcgggctggcaaggcgcatag

SEQ ID NO: 791689 - DNA, 686 bp, Homo sapiens
  misc_feature: 35938.44.35.D02.1.pb.heavy.1.raw 35938
cgtatcgcctccctccgcgccatcagacagtatatacacgaccggtgctcgatttagcacacgatagttgggtttggggatactttctgagactcatgggcctcctgcacaagaacatgaaaacacctgtggttcttcctcctcctggtggcaccttcccagatgggtcgtgtccgaggtgcagctgcaggagtcgggcccaggacgggtgaagccttcggagaccctgtccctcacctgcaatgtctctggtggttacatcagtagttttattggagttggctgcggcagtccgccgggaagggactggagtggattggggcgcatctataacagtggcagcaccaactacaacccccgccctcaagagtcgagtcaccatgtcactagacaggtccaagaaccagttctccctgaaattgacttctgtgaccccgccgcggacacggccgtatattattgtgcgagagattccctatcgataagagtagagacgggggggcgaactggctcgacccctggggccagggaacctggtcaccgtctcctcagctccaccacagggcccatcggtcttccccctggcaccctcctccaagagcacctctggggggccacgcccctgggctgctggtcaaggactcacttctatatactgtctgagcggctgggcaagcgcgccatag

SEQ ID NO: 791690 - DNA, 607 bp, Homo sapiens
  misc_feature: 35939.UNK.UNK.UNK.pb.heavy.1.raw 35939
gaaggctgggcaggctatgcaccctggtccagggtcaaaagctgcggaacccgctagcggccatcttggccactaggggtccccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatccagaccgatctggcgcctaaacgttcagtggtggctaaggcgtcaccttcgactgtctaaaggcaatatgttcgtccttagctccaagtccctagcaagcgtgtcgg

SEQ ID NO: 791691 - DNA, 654 bp, Homo sapiens
  misc_feature: 35955.44.86.H09.1.pb.heavy.1.raw 35955
ctatgcgccttgccagcccgctcagacagtatataggaagtagtccttgaccaggcagcccagggccgctgtgcccccagaggtgctcctggagcagggcgccagggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatcactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaaacccaagtctatagcactaaatcgagcaccggtcgtgtatatactgtctgatggcgcgagggaggcgatacg

SEQ ID NO: 791692 - DNA, 687 bp, Homo sapiens
  misc_feature: 35958.44.53.E09.1.pb.heavy.1.raw 35958
cgtatcgcctccctcgcgccatcagacagtatatacacgaccggtgctcgattttagagagagtgtgttgagctctgggagaggatccccagccttgggattcccaggtgttttcattcagtgatcaggactgaacacagaggacctcacatggagtttgggctgagctggattttccttgctgctattttaaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcggcccagggaaccctggtcaccgtctcctcagcctcgcaccaagggcccatcggtcttccccctggcgccctggctccaggagcacctccgagagcacagcggccctgggctgcctggtcaaggactacttcctatatactgtctgagcgggctggcaaggcgcatag

SEQ ID NO: 791693 - DNA, 656 bp, Homo sapiens
  misc_feature: 36031.44.29.C07.1.pb.heavy.1.raw 36031
cgtatcgcctccctcgcgccatcagtctatactatcacgaccggtgctcgatttagagtgctacgaagggaaaggggactcctgtgccccaccatggacacacttgctccacgctcctgctgctgaccatcccttcatgggtcttgtccagatcaccttgaaggagtctggtcctacgctggtgaagcccacacagaccctcacgctgacctgcaacctctctgggtctcactcaggagtgatggagcgattgtgggctggggtccgtcagcccccaggaaaggccctggagtggcttgcactcatttattggatgatgataggcgctacagtccatctctgaagagcagactctccatcacggagacgcctccaatacgcaggtgatccttagagtggccaacatggcccctgcggacacagccacatactactgcgcacacatgatcaactattataaaagtggtggtatgtgagtggcttgatatctgggccaaggacaatggtcaccgtctcttcagcctccacaagggcccatcggtcttccccctggcgccctgctccaggagcacctccgagagcacagcggccctgggctgcctggtcaaggactacttcctatatagctgtctgagcgggctggcaaggcgcatagg

SEQ ID NO: 791694 - DNA, 650 bp, Homo sapiens
  misc_feature: 36078.44.86.H09.1.pb.heavy.1.raw 36078
cgtatcgcctccctcgcgccatcagacagtatatacacgaccggtgctcgatttagtgctatagacttgggtttggggatgctttctgagagtcaaggcctcctgtgcaagaacatgaagcacctgtggtttttcctcctgctggtggcagctcccagatgggttcctgtcccaggtgcagctgcaggagtcgggccccaggactggtgaggccttcggaacctgtctctcatctgcactgtctctggagtttccatcagttctgatcattcttgggctggatccggcagcccccaggaggggaatggagtgattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcacccctggtcactgtctcctcagcttccaccaagggcccatcgtcttccccctggcgccctgctccaggagcacctctgggggcacagcggccctgggctgcctggtcaaggactacttcctatatactgtctgagcgggctggcaaggcgcatag

SEQ ID NO: 791695 - DNA, 692 bp, Homo sapiens
  misc_feature: 36096.44.56.F01.1.pb.heavy.1.raw 36096
ctatgcgccttgccagcccgctcagacagtatataggaagtagtcttgaccaggcagccagggccgctgtgccccagaggtgctcctggagcagggcgccagggggaagaccgatgggccttggtggaagctgaagagacgtgaccattgtccctggccccaaatatcaaatgcatcgacgtccaggaatcgcctggcgcagtaatagacgctgtgtcgtcggtctcaggttgctcatttgtaatggccaacactgttggagtcatcccttgagacggtgaatcttccttcacagacgcggtactctttacttccaccataacgtttcattctgacgaaagtgatccactcaagccccttcctggagcctgacggacccaggccaaggataatcactaagactgaatcctgagactacacaggagagtctcaggaccgccctggctgtgccagcccccccgactccgccagtcgccctcgcactggacaccttctaaaaaactacagaaaatcaagattagcccaaactccatggttggtggtctgtgctcagtgctgatcaccaagtggaaactcctgggaatctcacggctggggctcctctccagagctcccctttgtgtgttcagacgtctgctaaatcgagcaccggtcgtgtatatactgtctgatggcgcgagggaggcgatacg

SEQ ID NO: 791696 - DNA, 695 bp, Homo sapiens
  misc_feature: 36099.UNK.UNK.UNK.pb.heavy.1.raw 36099
cgtatcgcctccctccgcgccatcagacagtatatacacgaccggtgccgatttagcactcgcacgttggggtttgggggggagaggagcccagcactgggattccgagtgtttccattcggtgatcagcactgaacacagaggactcaccatggagtttttggctgagctgggttctccttgttggacttttaaaggtgtccagtgtgagtgcggctgatggagtctggaggaggcttagtccagcctggcggtcccagagacttcctgtgcagcctctggctcccgtcagcagcaactacatgagttgggtccgccaggctccagggaaggctggagtggtctcagtcatttatactggtgattttcacatactacgcagactccgtgaagggccgattcaccatctccagggacaatccaggaacacggtttatcttcaatgaacaacctgagaggcgacgacacggccgtctattactgtgcgagaccagtcggcgctcggagtggttattatcgtttgaccttctgggccagggaaccctggtcaccgtcgcctccgcctccaccaagggccatcggtcttccccccctggcaccctcctccaagagcactctggggcacagcggccctgggctgcctggtcaaggactacttcctatatactgtctgagcgggctggcaaggcgcatag

SEQ ID NO: 791697 - DNA, 682 bp, Homo sapiens
  misc_feature: 36119.44.27.C05.1.pb.heavy.1.raw 36119
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtgccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggtcattcgacgcctggggccagggaaccctggtcaccgtctcctcgcctccaccaagggcccatcggtcttccccctggcgccctgctccaggagcacctccgagagcacagcggcctggctgcctggtcaaggactacttcctatatactgtctgagcggctg

SEQ ID NO: 791698 - DNA, 682 bp, Homo sapiens
  misc_feature: 36142.44.78.H01.1.pb.heavy.1.raw 36142
cgtatcgcctccctcgcgccatcagacagtatatacacgaccggtgctcgatttagtgtgagtagtttgggtttgggagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtctggggagtttggtaaagccggggagtcccttagactctcctgtgcagcctctggatcactttcagtacgcctggatgacctgggtccgccaggcccagggaaggggctggagtgggttggccgtatagaaccaaagctgaacggttgacagcagactacgctgcacccgtgaaggcagattcaccatctcaagagatgattcaaaagatacggtgtctctgcagatgaacagcctgaacaccgaggacacagccgtctattactgtctgggatggtttcatcgggccagggaccctggtcaccgtctcctcagcctccaccaagggcccatcggtcttccccctggcgccctgctccaggagcacctccgagagcacagcggcccctgggctgcctgggtcaaggactacttcctatatactgtctgagcgggctggcaaggcgcatag

SEQ ID NO: 791699 - DNA, 679 bp, Homo sapiens
  misc_feature: 36144.44.45.E01.1.pb.heavy.1.raw 36144
cgtatcgcctcctcgcgccatcagacagtatatacacgaccggtgctcgatttagtgagtcagtaagggaaaggggctgggagagagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 791700 - DNA, 604 bp, Homo sapiens
  misc_feature: 36150.UNK.UNK.UNK.pb.heavy.1.raw 36150
gaaggctgggcaggctatgcaccctggtccaggtcaaaagctgcggaacccgctagcggccatctggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaactagtactttgcggttaggggaagtagacaaacccattactccacttcccggaagttcaactcattccaacacgaaataaaagtaaactcaacacccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791701 - DNA, 656 bp, Homo sapiens
  misc_feature: 36155.44.23.C01.1.pb.heavy.1.raw 36155
cgtatcgcctccctcgcgccatcagacagtatatacacgaccggtgctcgatttagtacacgtgattagggattgggggctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccccagggaggggaatggagtggattggtgacatccattatactggggcgacgtactactctccgctccctcaagagtcgtctcaccatttcgaggggacacgtccatgaaccgccttctcctgaaactgacctccgtgaccgccgcggacacggccgtttatttctgtgcgaggcgagactggtctttcaatctatggggccgtggcacccctggtcactgtctcctcagcttccaccaagggcccatcggtcttccccctggcgccctgctccaggagcactctgggggcacagcggccctgggctgcctggtcaaggactacttcctatatactggtctgagcgggctggcaaggcgcatag

SEQ ID NO: 791702 - DNA, 697 bp, Homo sapiens
  misc_feature: 36158.UNK.UNK.UNK.pb.heavy.1.raw 36158
cgtatcgcctcctcggcgccatcagacagtatataccagaccggtgctcgatttagtagctctatcagggggagcaccacataacaaccacattcctcctctaaagaagccctgggagcacagctcatcaccatggactggacctgggaggttcctctttgtggttggcagcagcaacaggtgtccagtccctggtgcaactggtgcagtctggacagaatgccgcaacctggtctcggtgaccctttcctgcacggcctctggaagtactaccgttccatatttcaccatcaactgggtgcgccagggcccctggacaaggcttgaggtggatgggtggaatcatccttcttttggttcactcactacgcacgagacttccgggggcagattacgattaccgcggacaagtccacaggacacgccagtctccatgacaatgagttctttgaaatccgacgacaccggccggtctactactgtgcgagaggctccgtaaccaggctcggcatgggagcctttgagatctggggccagggaacgctggtcattggtcactcagcgttccccaagggccatcgcggtcttcccctggcgccctgctccaggagcacctctggggcacagcggcccctgggctgcctggtcaaggactacttcctatatactgtctgaggcgggctggcaaggcgcatag

SEQ ID NO: 791703 - DNA, 690 bp, Homo sapiens
  misc_feature: 36171.44.73.G07.1.pb.heavy.1.raw 36171
ctatgcgccttgccagcccgctcagacagtatataggaagtagtccttgaccaggcagccagggccgctgtgctctcgaggtgctcctggagcagggcgccaggggaagaccgatggcccttggtggaggctgaggagacggtgaccagggttccctggccccagtagtcaagcggggaccgtctcgaggggctctcgcacaaataatagacagccgtgtcctcacttgtgaggttgtacatttgcagatgcagtgtttcctggaattgtctctggagacggtgaatcggcccttctcggagtctccgtagtggttcttcaattcatctctgatataattgccacccactccagccccttgcctggagcctggcggacccagtgcatggcataggtcctgaagatgaatccagaggctgcacaggagagtctcagggagttcccaggctgggccgctcctccccccagactccactagctgcacctgacactgggccacctcttaaaagagcaacgaggaaacccatctcagccaaagtccatggtgagtcctctgtgttcagtgatgatcaccgaatggaaacaccggcgacttccagtgctgggctcgtcctccccccccctgagcgtagagctaaatcgagcaccggtcgtgtatatactgtctgatggcgcgagggaggcgatacg

SEQ ID NO: 791704 - DNA, 591 bp, Homo sapiens
  misc_feature: 36174.44.78.H01.1.pb.heavy.1.raw 36174
cgtatcgcctccctcgcgccatcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791705 - DNA, 702 bp, Homo sapiens
  misc_feature: 36180.44.27.C05.1.pb.heavy.1.raw 36180
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 791706 - DNA, 583 bp, Homo sapiens
  misc_feature: 36249.44.78.H01.1.pb.heavy.1.raw 36249
ctatgcgccttgccagccccgctcagacagtatataggaagtagtccttgaccaggcagcccagggccgctgtgctctcggaggtgctcctggagcagggcgccagggggaagaccgatgggcccttggtggaggctgaggagaaacggtgaccagggttccctggccccacaagtcaagcccaggtggctggtggctctcgcacagaaatacacggccgtgtcctcagatctcaggctgcttcaggttccatgtagactgtacctggggaggtgctcctggtcatactaactctgcctttggaacttcctgggcaaagccgtgttgccactatagggcttcatccatcccatccactccagcccttgtccagcggcctgtcgcacccagttaatatcataattgatgaacgtgtatccagaaagccgtggcaggagtactgtcactgaggcccaggcttcttcacctcagcagcgtgtgaccgtgacctccagcaacttcgggcacccaaacccaaactactcacactaaatcgagcaccggtcgtgtatatactgtctgatggcgcgagggaggcgatacg

SEQ ID NO: 791707 - DNA, 665 bp, Homo sapiens
  misc_feature: 36263.44.23.C01.1.pb.heavy.1.raw 36263
cgtatcgcctccctccgcgccatcagacagtatatacacgaccggtgctcgatttagtacacgtgattagggattggggggctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggagtttccatcagttctgatcatcttcttggggctggatccggcagccccaggggaggggaatggagtggattggtgacatccatttaatacgggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggcgccgtggcacccctggtcactgtctcctcagcttccaccaaagggcccatcggtcttccccctggcgccctgctccaggagcacctctgggggcacagcggccctgggctgcctggtcaaggactacttccctatatactgtctgagcgggctggcaaggcgcatag

SEQ ID NO: 791708 - DNA, 669 bp, Homo sapiens
  misc_feature: 36272.44.35.D02.1.pb.heavy.1.raw 36272
cgtatcgcctccctcgcgccatcagacagtatatacacgaccggtgctcgattagcacacgatagttgggtttggggatactttctgagactcatgggccctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtcgccggaagggactggagtggattgggcgcatctataacagtggcagcaccaactacaacccgccctcaagagtcgagtcaccatgtcactagacaggtccaagaccagttctccctgaaattgacttctgtgaccgcgcgacacggccgtatattattgtgcgagagattcctatcgatacagtagagacggggggcgaactggctcgacccctggggccagggaaccctggtcaccgtctcctcagcctccaccaagggccatcggtcttcccctggcaccctcctccaagagcacctctgggggcacagcggccctgggctgcctggtcaaggactactcctatatactgtctgagcggctggcaagggcgcatag

SEQ ID NO: 791709 - DNA, 702 bp, Homo sapiens
  misc_feature: 36279.44.27.C05.1.pb.heavy.1.raw 36279
cgtatcgcctccctcgcgccatcagacagtacacgaccggtgctcgatttagacgcgatcgaagggtttggggcctgggagacgagcccagcactggaaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791710 - DNA, 704 bp, Homo sapiens
  misc_feature: 36284.44.36.D03.1.pb.heavy.1.raw 36284
cgtatcgcctccctcggcgccatcagacagtatatacacgaccggtgctcgatttagctgcgtcacgatctctcttggggagctctgagagcggagccccagccccagaattcccaggtgttttcattggtgatcagcactgaacacagaggactcaccatggagttcgggctgagctgggttttccttgttgttattttacaaggtgtccagagtgaagtgcagttggtggagtccgggggaagacttggtccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791711 - DNA, 714 bp, Homo sapiens
  misc_feature: 36299.UNK.UNK.UNK.pb.heavy.1.raw 36299
cgtatcgcctcccccgcgccatcagacagtatatacacgaccgtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggctttttaaaagggtgtcgtgtgtgaagtgcaggttgttgagtctggggggggggcctgattcggcctgggaggtccctgaccctctcctgtgcggcctctggattcacctttagtgcctattggcatgaccctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggacccacggtgacccccccatgacacctttagtacttgggccggggacagtggtgaccgtctcttcagccctccaccaagggccatcggtcttccccctggcgccctgctccaggagcacctccgagagcacagcggccctgggctgcctggtcaaggactacttcctatatactgtctgagcgggctgcaaggcgcatag

SEQ ID NO: 791712 - DNA, 712 bp, Homo sapiens
  misc_feature: 36325.UNK.UNK.UNK.pb.heavy.1.raw 36325
ctatgcgcccttgccagccccgctcagacagtatgtagtataagtagtccttgaccaggcagcccagggccgctgtgctctcggaggtgctcctgggagcagggcgccaggggaagaccgatggcccttggtggaggccggaggaacggtgaccagcgttccctggcccaggcgtcgaatgaccgattttggaaacgatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccaccgacacccagccctcgcctgcgagcctggcgggaccactgcatttccaattatgcgaagggtgaatccaggaggctgcacaggagagtctcagggaccccccctacggggcacgcctccccccagactcaccgaattgcacctgacagcatgacagccctcttaagagggcaaccgaggaaaaccagctcagcccaaactccatggtgagtcctctgtgttcagtgatgatccacgagtgaaacaccgcggcgacttccagtgctggcgctcgtctcccaggcccaaacccttcgatcgcgtcttaatcgagcacggtcgtggtatatactgtctgatggcgcgagggaggcgatacg

SEQ ID NO: 791713 - DNA, 565 bp, Homo sapiens
  misc_feature: 36407.UNK.UNK.UNK.pb.heavy.1.raw 36407
cgtatcgcctccctcgcgccatcagacagtatatacacgaccggtgctcgtttagtgtgagtagtttgggtttggtgcgccgaagttgctggaggtcacggtcaccacgctgctgaggtgaagaagcctgggggcctcagtgacagtctcctgcacggcttctggatacacgttcatcaattatgatattaactgggtgcgacaggccgctggacaaggctggagtggatggatggatgaagccctatagtggcaacacgggctttgcccagaagttccaaggcagagttagtatgaccaggagcacctcccaggtacagtctacatggaactgagcagcctgagatctgaggacacggcggtgtatttctgtgcgagagccaccagcacctggcttgacttgtggggcaggaaccctggtcaccgtctcctcagcctcacaagggccatcggtcttccccctggcgccctgctccaggagcacctccgagagcacagcggccctgggctgcctggtcaagactacttcctatatactgtctgagcgggctggcaaggcgcatag

SEQ ID NO: 791714 - DNA, 673 bp, Homo sapiens
  misc_feature: 36416.44.53.E09.1.pb.heavy.1.raw 36416
ctatgcgccttgccagccgctcagacagtatataggaagtagtccttgaccaggcagcccagggccgctgtgctctcggaggtgctcctggagcagggcgccaggggaagaccgatggcccttggtggaggctgaggagacggtgaccagggttccctggccgaatgaaaccatcccagacagtaatagacggctgtgtcctcggtgttcaggctgttcatctgcagagacaccgtatctttgaatcatctcttgagatggtgaatctgcctttcacgggtgcagcgtagtctgctgtcccaccgtcagctttggttctaatacggccaacccactccagccccttccctggagcctggcggaccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgatgaaaacacctgggaatcccaaggctgggctcctctccagagctcaacacactctctctaaatcgagcaccggtcgtgtatatactgtctgatggcgcgaggaggcgatacg

SEQ ID NO: 791715 - DNA, 697 bp, Homo sapiens
  misc_feature: 36447.44.36.D03.1.pb.heavy.1.raw 36447
cgtatcgcctccctcgcgccatcagacagtatatacacgaccggtgctcgatttagctgcgtcacgatctctcttggggagctctgagagcggagccccagccccagaattccaggtgttttcattggtgatcagcactgaacacagaggactcaccatggagttcgggctgagctggtttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtcgtgaaagccagatcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 791716 - DNA, 697 bp, Homo sapiens
  misc_feature: 36450.UNK.UNK.UNK.pb.heavy.1.raw 36450
cgtatcgcctccctcgcgccatcagacagtatatacacgaccggtgctcgatttagcagacgttgacacacaaaggggctgggagaggagccccagccgtgagattcccaggagttccacttggtgatcagcactgagcacagaccaccaaccatggagttgggctaatctgattttccttgtagtttttttagaaggtgtccagtgcgaggggcgactggcggagtcgggggggcttggcacagccaggcggtctctgagactctcctgtgtagtctcaggattcagtcttagtgattatcacttggcctggtccgtcaggctccagggaaggggcttgagtggatcacttcgtcagaatgaaacgtatggtggaagtaaagagtacgccgcgtctgtgaagggaagattcaccgtctcaagggatgactccaacagtgttggccatttacaaatgagcaacctgagacccgacgacacaggcgtctatactgcgccaggcgatcctgggacgtcgatgcatttgatattggggccaggggacaatggtcaccgtctcttcgcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791717 - DNA, 760 bp, Homo sapiens
  misc_feature: 36460.UNK.UNK.UNK.pb.heavy.1.raw 36460
ctatgcgccttgccaagcccgctcagacagtatataggaagtagtcctgaccaggcagcccagggccgctgtgcccccagaggtgctcctggagcagggcgccagggggagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcatttctgacgaaagtgatccactcaagccccttccctggagcctgacggaccaggcaaaagtgataatcactaagactgaatcctgagactacacaggagagtctcagagaccgccctggctgtgccaagcccccccccgactccgccagtcgcccctcgcactggacaccttctaaaaaaaactacaaggaaatcaagattagcccaaactccatggtggtggtctgtgctcagtgctgatcaccaagtggaaaccctgggaatctccacggctggggctcctctcccaggctccccgctttggctcctgtgttcagacgtctgtctaatacgatctgctaaagaacaccccggtcgcgtatatactgtcgatggctcgagggcgcgatacatcttacctgaagggcatacccgatctcg

SEQ ID NO: 791718 - DNA, 704 bp, Homo sapiens
  misc_feature: 36469.44.55.E11.1.pb.heavy.1.raw 36469
cgtatcgcctccctcgcgccatcagacagtatatacacgaccggtgctcgatttagcactcgcacgttggttttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagagggcgacgacacggccgtctattactgtgcgagacaagtcggcgctcggagtggttattattcgtttgacttctggggccaggggaaccctggtcaccggtcgcctccgcctccaccaagggcccatcggtcttcccctggcaccctcctccaagagcacctctgggggcacagcggccctgggctgcctggtcaaggatacttcctatatactgtctgagcgggctggcaaggcgcatag

SEQ ID NO: 791719 - DNA, 705 bp, Homo sapiens
  misc_feature: 36476.44.85.H08.1.pb.heavy.1.raw 36476
agcccgctcagacagtatataggaagtagtccttgaccaggcagcccagggccgctgtgcccccagaggtgctcttggaggagggtgccagggggaagaccgatgggcccttggtggaggctgaggagacggtgaccgtggtccttggccccagacgtccataccgtagtagtagtccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaacccagctcagcccaaactccatggtgagtcctctgtgttcagtgctgatcaccgaatggaaacaccgccgacttctagtgctgggctcctctccagagctccccgcgactgagtgatactaaatcgagcaccggtcgtgtatatactgtctgatggcgcgagggaggcgatacg

SEQ ID NO: 791720 - DNA, 675 bp, Homo sapiens
  misc_feature: 36492.44.27.C05.1.pb.heavy.1.raw 36492
cgtatcgcctccctcgcgccatcagacagtatatacacgaccggtgctcgattagacgcgatcgaaggtttgggggaagaggaagtcgccggtgtttccactcggtgatcatcactgaacacagagactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctgattcaccttcgataattggatatgcagtgggtccgccaggctccagcgagggctggagtgggtggcaggtgtgtcatttcatggaggaaatcaagtctacggtgattccgtgaggccgattcaccatctccagagacaattccgagaacacagtgtctcttcaaatgaacagcctgagacctcaggacacggccgtgtattttgtgcgagactatctgtttccaaaatcggttcattcgacgcctggggccaggaaccctggtcaccgtctcctcggcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 791721 - DNA, 641 bp, Homo sapiens
  misc_feature: 36503.44.86.H09.1.pb.heavy.1.raw 36503
gcgccttgccagcccgctcagacagtatataggaagtagtccttgaccaggcagcccaggccgctgtgccccagaggtgctcctggagcaggcgccagggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctaccaccagcaggagaaaaaccacaggtgcttcatgttcttgcacaggaggccttgactctcagaaagcatccccaaacccaagtctatagcactaatcgagcaccggtcgtgtatatacgtctgatggcgcgagggaggcgatacg

SEQ ID NO: 791722 - DNA, 601 bp, Homo sapiens
  misc_feature: 36504.UNK.UNK.UNK.pb.heavy.1.raw 36504
gaaggctgggcaggctatgcaccctggtccaggtcaaaagctgcggaccccgctagcggccatcttggccactagggtcccgcagattcatattgtcgtctagcatgcacaatgctgcaaacccagcttgcaatgcccacagcaagcggccaatctttacgccacgttgaatgtttattacctgtgactggctatggcttgcaacgccactcgtaaaactagtacttgcggttaggggaagtagacaaacccattactccacttccggaagttcaactcattccaacacgaaataaaagtaaactcaacaccccaagcaggctatgtgggggggtgatagggtggattctatttcctatcccatcccctaggatctcaattaagttactagcgagttaaatgtctgtagcgatcccgtcagtcctatcgcgcgcatcaagacctgttgttgagcgtgcagtagatcatcgataagctgcggagttaggtcatccagaccgcatctggcgcctaaacgttcagtggtagctaaggcgtcaccttcgactgtctaaaggcaatatgtcgtccttagctccaagtccctagcaagcgtgtcggg

SEQ ID NO: 791723 - DNA, 576 bp, Homo sapiens
  misc_feature: 36506.44.78.H01.1.pb.heavy.1.raw 36506
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttcctggcccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtcccagcggcctgtcgcacccagttaatatcataatgatgaacgtggtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgcgagggaggcgatacg

SEQ ID NO: 791724 - DNA, 699 bp, Homo sapiens
  misc_feature: 36540.UNK.UNK.UNK.pb.heavy.1.raw 36540
ctatgcgccttgccagcccgctcagacagtaatataggaagtagtccttgaccaggcagcccagggccgctgtgctctcggaggtgctcctggagcaggggcggccaggggaagaccgatgggcccttggtggaggctgaggagacggtgaccagggttccctggccccagtagtcaagcggggaccgtctcgagggggctctcgcacaataatagacagccgtgtcctcacttgtgaggttgtacattttgcagatgcagtggttcctgattgtctctggagacggtgaatcggcccttctcggagtctccgtagtgttcttcaattccatcttctgatataattgccacccactccagccccttgcctggagcctggcggacccagtgcatggcataggtcctgaagatgaaatccagaggcctgcaacaggagagtctcagggagttcccaggctgggccgctcctccccagactccactagctgcacctgacactggccacctcttaaaagagcaacgagggaaaaccccatctcagcccaaagtccatggtgagtcctctgtgttcagtgatgatcaccgaatggaaacaccggcggactttccagtgctgggctcgtctcccccctgagcgtagaggctaaatcgagcaccggtcgtgtatatactgtctgatggcgcgagggaggcgatacg

SEQ ID NO: 791725 - DNA, 704 bp, Homo sapiens
  misc_feature: 36598.44.55.E11.1.pb.heavy.1.raw 36598
ctatgcgccttgccagtaggaagtagtccttgaccaggcagcccagggccgctgtgcccccagaggtgctcttggaggagggtgccaggggaagaccgatgggcccttggtggagggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctaggaattgtccctggagatggtgaaatcggcccttcacggagtcctgcgtagtatgtgaaatcaccagtataaatgactgagaccactccagcccctttccctggagcctggcggacccaactcatgtagttgctgctgacggtgagcccagaggctgcacaggagagtcctctgggaccccccaggctggactaagcctcctccagactccatcagccgcacctgacactggtcacactggacaccttttaaaagatccaaacaaggagaacccagctcagccaaactccatggtgagtcctctgtgttcagtgctgatcaccgaatggaaaacacctcggaatcccagtgctgggctcctctcccccccaaacccaacgtgcgagtgctaaatcgagcaccggtcgtgtatatactgtctgatggcgcgagggaggcgatacg

SEQ ID NO: 791726 - DNA, 713 bp, Homo sapiens
  misc_feature: 36607.44.33.C11.1.pb.heavy.1.raw 36607
ctatggcgccttgccagcccgctcagacagtatataggaagtagtccttgacaggcagcccagggcgctgtgcccccagaggtgctcttggaggagggtgccagggggaagaccgatgggcccttggtggaggctgaggagacggcgacgtggtcccttggccccaggcgtccataccattggagtagagcatgtcatatctgtatccacgagcccatctctcgcacagtagtagacagccgtgtcctcggctctcaggctattcatttccagatatagtggtgttcttcgaattgtctctggagatggtgaatcggcccttcacggaatctacataatattattacttccatcataccatataatgccacccactccagtcccttgcctggagcctggcggacccagtgcatgccatgtctgttgaagtgaatccagacgctacacaggagagtctcagggacctccaggctggacacgcctccccagactccaccagcttcacctgacactggacacctcttaaaagagcaacgaggaaaaccaggtcagcccaactccatgtgagtcctctgtgttcggtgctgatcaccgactggaaacaccgccgacttctggtgctgggctcctctccagccccaaaccaacgagctcactctaaatcgagcaccggtcgtgtatatactgtctgatggcgcgagggaggcgatacg

SEQ ID NO: 791727 - DNA, 664 bp, Homo sapiens
  misc_feature: 36620.44.12.B01.1.pb.heavy.1.raw 36620
ctatgcgccttgccagcccgctcagacagtatataggaagtagtccttgaccaggcagccagggccgctgtgtccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtcaatgactctcagaaagcccccgcggaatctacactactaaatcgagcaccggtcgtgtatatactgtctgatggcgcgagggaggcgatacg

SEQ ID NO: 791728 - DNA, 662 bp, Homo sapiens
  misc_feature: 36634.44.12.B01.1.pb.heavy.1.raw 36634
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggccaggactggtgaagccttcggagacccgtccctcacctgcactgtctctggtggctccatcagcagtagtagttactactggggctggatccgccagcccccagggaaggggctggagtggattgggagtatctattatagtgggagcacctactacaacccgtcccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggccatcggtcttccccctggcacctcctccaagagcacctctgggggcacagcggccctgggctgcctggtcaaggactacttcctatatactgtctgagcggggctggcaaggcgcatag

SEQ ID NO: 791729 - DNA, 680 bp, Homo sapiens
  misc_feature: 36637.44.55.E11.1.pb.heavy.1.raw 36637
cgtatcgcctccctcggcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctccggaagtggttattattcgtttgacttctggggccagggaaccctggtcaccgtcgcctccgcctccaccaagggcccatcggtcttcccctggcaccctcctccaagagcacctctggggcacagcggccctgggctgcctggtcaaggactacttcctatatactg

SEQ ID NO: 791730 - DNA, 595 bp, Homo sapiens
  misc_feature: 36653.UNK.UNK.UNK.pb.heavy.1.raw 36653
cccgacacgcttgctagggacttggagctaaggacgacatattgcctttagacagtcgaaggtgacgccttagcaccactgaacgtttaggcgccagatgcggtctgggatgacctaactcgcagccttatcgatgatctactgcacgctcaaccaaccaggtcttgatgcgcgcgataggactgacggatcgctacagacatttaactcgctagtaacttaattgagatcctaggggatgggataggaaatagaatccacccctatcacccccacatagcctgcttgggtgttgagtttacttttatttcgtgttggaatgagttgaacttccggaagtggagtaatgggtttgtctacttcccctaacgcaaagtactagttttacgagtggcggttgcaagccatagccagtcacaggtaataaacaattcaacgtggcgtaaagattggccgctgctgtggcattgcaagctggtttgcagcattgtgcatgctagacgacaatatgaatctgcgggaccctagtggccaagatggcgctagcggttccgcagctttgacctggaccagggtgcatagcctgcccagcctc

SEQ ID NO: 791731 - DNA, 694 bp, Homo sapiens
  misc_feature: 36666.44.36.D03.1.pb.heavy.1.raw 36666
cgtatcgcctccctcgcgccatcagacagtatatacacgaccggtgctcgatttagctgcgtcacgatctctcttgggggagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagactttgtccagcctggaggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 791732 - DNA, 679 bp, Homo sapiens
  misc_feature: 36672.UNK.UNK.UNK.pb.heavy.1.raw 36672
ctatgccttgccagcccgctcagacagtatataggaagtagtccttgaccaggcagcccaggccgctgtgcctcccggaggtgctcctggagcaggcgccaggggaagaccgatgggcccttggtggagcgagagacggtgaccaggttcctgcccaggcgtcgaatgaaccgattttggaaacagatagtctcgcacaaaatacacgccgtgtcctgaggtctcaggctgttcatttgaagagacactgtgttctcggaattgtctctggagatggtgaatcggcctcaacggatcaccgtagacttgatttcctccatgaaatgacacacctgccacccactccagcccctcgctggagcctggcggacccactgcatattccaattatcgaaggtgaatccagagggctgcacaggagagtctcaggtaccccccctactgggcacgcctccccagactccacgaattgcacctgacacatgacacctcttagaggcaacgaggaaaacccagctcagccaaactccatggtgagtcctctgtgttcagtgatgatcaccgagtgaaacacggcgacttccgtgctggctcgtctcccagccccaaacccttcgatcgcgtctaaatcgagcacggtcgtgtatatactgtctgatggcgcgagggaggcgatacg

SEQ ID NO: 791733 - DNA, 700 bp, Homo sapiens
  misc_feature: 36753.44.27.C05.1.pb.heavy.1.raw 36753
cgtatcgcctccctcgcgccatcagacagtatatacacgaccggtgctcgatttagacgcgatcgaaggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcgtcttcccctggcgccctgctccaggagcacctccgagagcacagcggccctgggctgcctggtcaaggactacttcctatatactgtctgagcgggctggcaaggcgcatag

SEQ ID NO: 791734 - DNA, 611 bp, Homo sapiens
  misc_feature: 36757.UNK.UNK.UNK.pb.heavy.1.raw 36757
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgccatcaagacctggttggttgagcgtgcagtagatcatcgataagctgcgagttaggtcatcccagaccgcatctggcgcctaaacgttcagtggtagctaaggcgtcaccttcgactgtctaaaggcaaatatgtcgtccttagctccaagtccctagcaagcgtgtcggg

SEQ ID NO: 791735 - DNA, 660 bp, Homo sapiens
  misc_feature: 36760.UNK.UNK.UNK.pb.heavy.1.raw 36760
ctatgcgccttgccagccgctcagacagtatataaggaagtagtccttgaccaggcagcccagggccgcctgtgcccccagaggtgctctggaggagggggccagggggaagaccgatgggccctttggtggaggctgaggagacggtgaccggggtccctttgccccagacgtccatgtagtagtaatacttgtattgttgtaacttctgcgacctctggcacagtaataaagggccgtgtcgtccactcgcaggctcttcatctgcagaaacaccgtattcttggattgtccctggagacgatgagcggccccttcacggagtctgcgacatttgtgggcactaccaccagtaatggatgagaccactcagccccttccctggggcctgacggacccagatcatggcataggtattaaaggcgaatccagagctgcacaggagagtgtcagggacccccccggctgtaccagcctcccccgactccaacagctgcacttcacactgacaccttttaaaacagcacaagaaaagccagctcagcccaaactccatggtgagttctctctgtcagtcccagggctgggcccctctcttcttgcgacgacactaaatcgagcaccgtcgtgtatatacgtctgatggcggagaggcgaacg

SEQ ID NO: 791736 - DNA, 670 bp, Homo sapiens
  misc_feature: 36769.UNK.UNK.UNK.pb.heavy.1.raw 36769
ctatgcgccttgccagcccgctcagacagtatataggaagtagtccttgaccaggcaggccccagggccgctgtgccccccagaggtgctcctggagcagggccgccagggggaagaccgatgggcccttggtggaagctgaggagacagtgaccagggtgccacggccccatagattgaaagaccagtctcgcctcgcacagaaataaacggccggtgtccgcggcggtcacggaggtcagtttcagggagaagcggttcatggacgtgtccctcgaaatggtgagacgactcttgagggacggagagtagtacgtcgccccagtataatggatgtcaccaatccactccattcccccctccctgggggctgccggatccagccccaagaatgatcagaactgatggaaactccagagacagtggcagatgagagacagggttcccgaaggcctcaccagtcctgggcccgactcctgcagctgcacctgggacaggacccatctgggaggctggccaccagcaggaggaaaaaccacaggtgcttcatgttcttgcacaggaggtccttgactctcagaaagcatcccccaaaccaagtctatagcactaaaatcgaggcagccggtcgtgtatatactgtctgatgggcgcgaagggaggcgatacg

SEQ ID NO: 791737 - DNA, 652 bp, Homo sapiens
  misc_feature: 36772.UNK.UNK.UNK.pb.heavy.1.raw 36772
ctatgcgccttgccagcccgctcagacagtatataggaagtagtcttgaccaggcagcccagggcccgctgtgctctcggaggtgctcctggagcaggcgccaggggaagaccgatgggcccttggtggaggctgatgagacggtgacctggattttccctggccccaggttcgaagaagcccgtggtcattgtggtcatgaagtgggcacagaaatatgtgcctgtgtccacagggggtccacgttgtcaatgtaaggaccacctggttttttggacgtgtcctcgtggagcgtgagtctggtcgtcagagaaggactatatcgtatatcgtcattccaataagtgagttgcgatccactccaggccttccggggggctgcccgcacccagaccaacgccctctccaggagtgacgagttgagaagcctgagacggtgcaggtcagcgtgaagggtctgtgtgggtttcaccaatgtagggccagactctttcacggtgatctggggacaggcccatgaagggatggtcagcagcaggagcgtggagcaaagtgtgtccatggtggggcacaggagtccgcccttactgactcaactaaatcgagcaccggtcgtgtatatactgtctgatggcggcgaggaggcgatacg

SEQ ID NO: 791738 - DNA, 607 bp, Homo sapiens
  misc_feature: 36776.UNK.UNK.UNK.pb.heavy.1.raw 36776
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgatagggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791739 - DNA, 600 bp, Homo sapiens
  misc_feature: 36797.UNK.UNK.UNK.pb.heavy.1.raw 36797
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtgcgttgcaagccatagccagtcacaggtaataaacaattcaacgtggcgtaaagattggccgcttgctgtggcattgcaagctgggtttgcagcattgtgcatgctagacgacaatatgaatctgcggacccctagtggccaagatggccgctagcggttccgcagcttttgacctggaccagggtgcatagcctgcccagccttc

SEQ ID NO: 791740 - DNA, 700 bp, Homo sapiens
  misc_feature: 36820.UNK.UNK.UNK.pb.heavy.1.raw 36820
ctatgcgccttgccagccgctcagacagtatatagaagtagtccttgaccaggcagcccagggccgctgtgctctcggaggtgctcctggagcagggcgtcagggggaagaaccgatgggcccttggtggaggctgaggagacggtgaccagggttccctggccccagtggacagttcctgatataaacacaacacaataatacatgcccgtgtcctcggttttcaggttagtcattcgccagaatcaatgagttcttgaagtcatctcttgagagggtgaatctggctttcacagacgcgcgtactctgtgataaagctggcaactttgtttttactgcggccagccactccagccccttccctggagcctggcggacccagtccatatagtggtcactgatggtgaatccagaggcgacacaggagagttctcaggaccctccaggctggacaagtctccccggactccaccaactgcacttcactctggacaccttgtaaaataacaacaaggaaaacccagctcagcccgaactccatggctgagtcctcctgtgttcagtgctgatcaccaaatgaaaaaccctggggaattctggggctggggctccgctctccccaagagagatcgtgacgcaagctaaatcgagcaccggtcgtgtatatactgtctgatggcgcgcgagggaggcgatacg

SEQ ID NO: 791741 - DNA, 670 bp, Homo sapiens
  misc_feature: 36827.44.35.D02.1.pb.heavy.1.raw 36827
cgtatcgcctccctcgcgccatcagacagtattacacgaccggtgctcgatttagcacacgatagttgggtttggggatactttctgagactctgggcctccgtgcacaagacatgaaaacacctgtggttcttcctcctcctggtggcacctcccagatgggtcgtgtccgaggtgcagctgcaggaagtcgggcccaggacgggtgaagccttcgagaccctgtccctcacctgcaatgtcctggtggttacatcagtagttattattgggttgctgcggcagtccgccgggaagggactggagtggattgggcgcatctataacagtggcagcaccaactacaccccgcctcaagagtcgagtcaccatgtcactagacaggtccaagaaccagttctccctgaaattgactctgtgaccgccgcgacacggccgtatattattgtgcgagagattcctatcgatacagtagagacggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791742 - DNA, 635 bp, Homo sapiens
  misc_feature: 36876.UNK.UNK.UNK.pb.heavy.1.raw 36876
cgtatcgcctccctccggcgccatcagacagtatatacacgaccggtgctccgatttagtatctgatagcctgggttttccttgttgctcattttaaaaggtgtccagtgtgaggtgcagctggtggagtccggggaggcttagttcagcctggggggtccctgagactctcctgtgcagggcctctggattccacccttccagtagctactggatgcactgggtccgccaagctcccagggaaggggctggtgtgggtctcacgtattaatagtgatgggagtagcacaagctacgcggactccgtgaagggccgattcaccattctccagagacaacgcccaagaacacgctgtatctgcaaatgaacagtctgagagccgaggacacggctgtgtattactgtgcaagagccgcggtgcgggagttcgggagttgcatactactactacggtatggacgtctggggccaagggaccacggtcaccgtctcctcagcttccaccaaagcggcccatcggtcttcccctggcgccctgctccaggagcacctctggggcacaggcggccctgggctgcctggtcaaggactacttcctatatactgtctgagcggctgggcaagggcgccatag

SEQ ID NO: 791743 - DNA, 725 bp, Homo sapiens
  misc_feature: 36882.44.85.H08.1.pb.heavy.1.raw 36882
ctatgcgcctgccagccgctcagacagtaatataggaagtagtccttgacaggcagcccaggccgctgtgcccccagaggtgctcttggaggagggtgccaggggaagaccgatggcccttggtggaggctgaggagacggtgaccgtggtcccttgccccagacgtccataccgtagtagtagtcccagcaggtggtagtactacaatatgtcctcgcacagtaaatacacagccgtgtcctcggctctcaggctgttcatttgcagatacagcgtgttcttggaattgtctctggagatggtgaatcggcccttcacggagtctgcatagtatttattacttcccatcataccatataagtgccacccactccagcccccttgcctggagcctggcggacccagtgcatgccataggtactgaagggtgaatccagacgctgcacaggagagtctcagggacctcccaggctgggaccacgcctccccagactccaccagctgcacctggacactggacacctcttaaaagagcaacgaggaaaacccagctcaggcccaaactccatggtgagtcctctgtgttcagtgctgatcaccgaatggaaacacccgccgacttctagtgctgggctcctctcccagagctccccgcgactgagtgatactaaatcgagcaccggtcgtgtatatactgtctggatggcgcgagggaggcgatacg

SEQ ID NO: 791744 - DNA, 695 bp, Homo sapiens
  misc_feature: 36911.44.36.D03.1.pb.heavy.1.raw 36911
cgtatcgcctccctcgcgccatcagacagttatatacacgaccggtgctcgatttagctgcgtcacgatctctcttgggggagagcggagccccagcccagaattcccaggtgttttcatttggtgatcagcactgaacacagaggactcaccatggagttcgggctgagctgggttttccttgttgttattttacaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggctggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 791745 - DNA, 652 bp, Homo sapiens
  misc_feature: 36917.44.86.H09.1.pb.heavy.1.raw 36917
ctatgcgccttgccagcccgctcagacaagtatataggaagtagtccttgaccaggcagcccagggccgctgtgcccccagaggttgctcctggagcaggggcgccagggggaagaccgatgggcccttggtggaagctgaggagacagtgaccagggtgccacggccccatagattgaagaccagtctcgcctgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactcattcccctccctgggggctgccggatccagccccaagaatgatcagaactgatggaaactccagagacagtgcagatgagagacagggttcccgaaggcctcaccagtcctggcccgactcctgcagctgcacctggacaggacccatctggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 791746 - DNA, 601 bp, Homo sapiens
  misc_feature: 36966.UNK.UNK.UNK.pb.heavy.1.raw 36966
ccgacacgcttgctagggacttggagctaaggacgacatattgcctttagcagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaaatgagttgaacttccgggaagtggagtaatgggtttgtctactccctaaccgcaaagtactagttttacgagtggcgttgcaagcatagccagtcacaggtaataaacaattcaacgtggcgtaaagattggccgcttgcgtgggcattgcaagctgggttgcagcattgtgcatgctagacgacaatatgaatctgcgggacccctagtggccaagatggccgctagcggttccgcagcttttgacctggaccagggtgcatagcctgcccagccttc

SEQ ID NO: 791747 - DNA, 703 bp, Homo sapiens
  misc_feature: 36968.44.56.F01.1.pb.heavy.1.raw 36968
cgtatcgcctccctcgcgccatcagacagtatatacacgaccggtgctcgatttagcagacgtctgaacacacaaagggagctctgggagaggagccccagccgtgagattccaggagtttccacttggtgatcagcactgagcacagaccaccaaccatggagtttgggctaatcttgattttccttgtagttttttagaaggtgtccagtgcgagggcgactggcggagtcggggggcttggcacagccagggcggtctctgagactctcctgtgagtctcaggattcagtcttagtgattatcacttggcctgggtccgtcaggctccagggaagggggcttgagtggatcactttcgtcagaatgaaacgttatggtggaagtaaagagtacgccgcgtctgtgaagggaagatttcaccgtctcaaggatgactccaacagtgttggccatttacaaatgagcaacctgagacccgacgacacaggcgtctattactgcgccaggcgatctgggacgtcgatgcatttgatatttggggccaggggacaatggtcaccgtctcttcagcttgcacaagggcccatcggtcttccccctggcgccctgttccaggagcacctctggggcacagcggccctggctgcctggtcaaggactacttcctatatactgtctgagcgggctgcaaggcgcatag

SEQ ID NO: 791748 - DNA, 614 bp, Homo sapiens
  misc_feature: 36991.44.23.C01.1.pb.heavy.1.raw 36991
ctatgcgccttgccagcccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgcccagtataatggatgtcaccaatccactccattcccctccctggggctgccggatccagcccagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcacctggcccaatccctaatcacgtgtactaaatcgagcaccggtcgtgtatatactgtctgatggcgcgagggaggcgatacg

SEQ ID NO: 791749 - DNA, 706 bp, Homo sapiens
  misc_feature: 37046.44.62.F07.1.pb.heavy.1.raw 37046
cgtatcgcctccctcgcgccatcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcggcctggaggtcctgaccctctcctgtgcggcctctggattcacctttagtgcctatggcatgacctggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccgggggacagtggtgaccgtctcttcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 791750 - DNA, 619 bp, Homo sapiens
  misc_feature: 37065.UNK.UNK.UNK.pb.heavy.1.raw 37065
ccgacacgcttgctagggacttggagctaaggacgacatattgcctttagacagtcgaaggtgacgccttagctaccactgaacgttttaggccgcccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggaaaaataggaaagatccacccctatcacccccacatagcctgcttggggtgtggaggtttacttttatttcgtgttggaaatgagttgaacttccgggaagtggagtaatggtttgtctacttcccctaaccgcaaagtaactagtttttacgagtggcgttgcaagccatagcccagtccacaggtaataacaattcaaacgtggcgtaaagattggccgcttgctgtgggcattgcaagctgggttttgcagcattgtgcatgctagacgacaatatgaatctgcgggacccctagtggccaagatggccgctagcgggttttccgcagcttttttgacctggaaccgggtgcatagcctgcccagccttc

SEQ ID NO: 791751 - DNA, 657 bp, Homo sapiens
  misc_feature: 37080.44.81.H04.1.pb.heavy.1.raw 37080
cgtatcgcctccctcgcgccatcagacagtatatacacgaccggtgctcgatttagtagtgtagattcgcgggggctttctgagagtcatggacctcctgtgcaagaacatgaagcacctgtggttcttcctcctgctggtggcggctcccagatgggtcctgtccagctgcagctgcaggagtcgggcccaggactggtgaagccttcggagaccctgtccctcacctgcactgtctctggtggctccatcagcagtagtagttactactgggctggatccgccagccccagggaagggctggagtggattgggagtatctattatagtgggagcacctactacaaccgtccctcaagagtcgagtcaccatatcagtagacacgtccaagaaccagttctccctgaagctgagctctgtgaccgcgcggacacggccgtgtattactgtgcgagagtagggcagttcgtcaccaactactttgaccactggggccagggaaccctggtcaccgtctcctcagcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 791752 - DNA, 579 bp, Homo sapiens
  misc_feature: 37081.44.78.H01.1.pb.heavy.1.raw 37081
cgtatcgcctccctccgcgccatcagacagtatataccacgaccggtgctcgatttagtgtgagtagtttgggtttggtgccgaagttgctggaggtcgacggtcaccacgctgcctgaggtgaagaagcctgggccctcagtgacagtctcctgcacggcttctggatacacgttcatccaattatgatattaactgggctgcgacaggccggctggacaagggctggagtggatgggatggatgaagccctatagtggcaacacgggctttgcccagaagttccaaggcagagttagtatgaccaggagcacctccccaggtacaggtctaccatggaactgagcagcctgagatctgaggacacggccgtgtatttctgtgcgagagccaccagcacctggcttgacttgtggggccagggaaccctggtcaccgtctcctcagcctccccaagggcccatcgtcttccccctgggcgccctgctccaggagcacctccgagagcacagcggccctgggctgcctggtcaaggactacttcctatatactgtctgagcggcctggcaggcgcatag

SEQ ID NO: 791753 - DNA, 730 bp, Homo sapiens
  misc_feature: 37118.44.36.D03.1.pb.heavy.1.raw 37118
cgtatcggcctcccctcgcgccatcagacagtatatacacgaccggtgctcgatttagctgcgtcacgatctctcttgggagctctcagagaggtggccttagcccctggattccaaggcatttccacttggtgatcagcactgaacacagaggactcaccatggagttgggggctgcgctgggttttccttgtttgctattttagaaggtgtccactgtgaggtgcggctggtggagtctggggaggcttggtacagcggggggggtccctgagactctcctgtgcagcctctggattcatcttcagtgactatgccatgaactgggtccgccaggctccagggaaggggctggagtgggtttcatatatgttaatattgctggagataccacctactacgcagactctgtgaaaggcgccgattcaccaattccagggacaatgccaagaaactcactgtatctggaaatgaacagcctgagagacgaggacacggctgtctacttctgtttcgagaagatcggggccacttggtcagtggctggttttgactactggggccgggaaccctggtcaccggtctcctcagctccaccaggggcccatcggctttccccccttggcgcccttgctccaaggagcacctcccggagagcacagcggccctgggctgcctggtcaaggactacttcctatatactgtctgagcgggctggcaaggcgcatag

SEQ ID NO: 791754 - DNA, 677 bp, Homo sapiens
  misc_feature: 37119.44.53.E09.1.pb.heavy.1.raw 37119
ctatgcgccttgccagccgctcagacagtatatagaagtagtcctgacccaggcagcccagggccgctgtgctctcggaggtgctcctggagcagggcgccagggggaagaccgatgggcccttggtggaggctgaggagacggtgaccagggttccctggccgatgaaaccatcccagacagtaatagacggctgtgtcctcggtgtttcaggctgttcatctgcagagacaccgtatcttttgaatcatctcttgagatggtgatctgcctttcacggtgcagcgtagtctgctgtcccaccgtcagctttggttctaatacggcccaacccactccagccctctccctggagcctggcggacccaggtcatccaggcgttactgaagtgaatccagaggctgcacaggagagtctaagggactccccaggctttaccaaacctccccagactccaccaactgcacctcacactggacaccttttaaaatagcagcaaggaaaatccagctcagcccaaactccatggtgagtcctctgtgttcagtcctgatcactgaatgaaaacacctgggaatcccaaggctggggctctctcccagagctcaacacactctctctaaatcgagcaccggtcgtggtatatactgtctgatggcgcgagggaggcgatacg

SEQ ID NO: 791755 - DNA, 725 bp, Homo sapiens
  misc_feature: 37120.44.73.G07.1.pb.heavy.1.raw 37120
cgtatcgcctccctcgcgccatcagacagtatatacacgaccggtgctcgatttagctctacgctcaggggagctctggggagaggagcccagcactagaagtcggcgggtgttttccattcggtgatcagcactgaacacagaggactcaccatggagtttgggcctgagctgggttttctcgttactcttttaagaggtgtccagtgtcaggtgcacctgggtggagtctgggggaggcgtggggtccagcctgggaggtccctgagactctcctgtgaagcctctggatttagtttcagtagttctggcatgcactgggtccgccaggctccaggcaagggggcccggagtgggttggcagttatagcatatgatggaacttctagatattatgcagactccgtgaagggcccgattcaccatcctccagagacaattcccgggaacactctgtacctggaaatgatcagccctgagaggcgaggactcggctctgtattactgtgcgagatcgggaagtggcagcagctattatcgggcgtttcactgggggccaggggggacactggtcaccgtctcctcagcctcccaccaagggcccatcggtcttccccctggcgccctgctccaggagcacctccgagagcacagcggcccctgggctgcctggtcaaggactacttcctatatactgtctgagcgggctgggcaaggcggcatag

SEQ ID NO: 791756 - DNA, 697 bp, Homo sapiens
  misc_feature: 37130.44.27.C05.1.pb.heavy.1.raw 37130
cgtatgccctcctcgcgccatcagacagtatatacacgaccggtgctcgatttagacgcgatcgaagggtttggggggaagaggaagtcgccggtgtttcactcggtgatcatcactgaacacagaggactcaccatggagtttgggctgagctgggttttcctcgttgcccccttaaggaggtgtcatgtgcaggtgcaattcgtggagtctgggggaggcgtgcccagtaggggggctcctggagacctctcctgtggcaagcctctggattcaccttcgataattggaatatgcagtgggtccgccaggctccaggcgacgggctggagtggggtggcaggtgtgtcattcatggaggaaatcaagtctacggtgattccgttgagggccgattcaccattctccagagaacaattccgagaacacagtgtctcttcaaatgaaacagcctgagacctcaggacacggccggtggtatttttgtgcgagactatctgtttccaaaatcggttcattcgacgcctcgggccagggaaccctggcaccgtctcctcggcctccaccaagggcccatcgggtcttccccctggcgcccgcctccaggagcacctccgaggagcacagcggccctgggctgcctggtcaaggactacttcctatatactgtctgagcggggctggcaggcgcgcatag

SEQ ID NO: 791757 - DNA, 565 bp, Homo sapiens
  misc_feature: 37131.44.36.D03.1.pb.heavy.1.raw 37131
ctatgcgcttgccagcccgctcagacagtatataggaagtagtccttgaccaggcagcccagggccgctgtgcccccagaggtgctcttggaggagggtgccagggggaagacgatggcccttggtggagctgaggagacggtgaccaagggttcctggccccagtagtcaaagaacttcttttcttgcttgtcctctacggtctcgcacagtagtacacatctatgtcctcagatctctgactgctcagctccatgtaggctgtgctcgtggacgtgtccctggtcatggtgactctgccctgaaacttctgtgcatagcctgtgttacattgccagagtagctccctaccatccattcaaacccttatccaggggcctgtcacacacagtgaatgtcgtagctggcgaagtgtatccagagctttgcaggagaccttcactgaggccatggacgctggcaacaggagagtcatcagaagctgggtccccaagagagatcgtgacgcagctaaatcgagcaccggtcgtgtatatactgtctgatgcgcgagggaggcgatacg

SEQ ID NO: 791758 - DNA, 611 bp, Homo sapiens
  misc_feature: 37181.UNK.UNK.UNK.pb.heavy.1.raw 37181
gaaggctgggcaggctatgcaccctggtccaggttcaaaagctgcggaaccgcgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtggcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 791759 - DNA, 656 bp, Homo sapiens
  misc_feature: 37220.44.73.G07.1.pb.heavy.1.raw 37220
cgtatcgcctccctcgcgccatcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatctcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacgactgtctattattgtgcgagagccccctcgagacggtccccgcttgactactgggccagggaaccctggtcaccgtctcctcagcctccaccaagggcccatcggtcttccccctggcgccctgctccaggagcacctccgagagcacagcggccctgggctgcctggtcaaggactacttcct

SEQ ID NO: 791760 - DNA, 703 bp, Homo sapiens
  misc_feature: 37232.44.62.F07.1.pb.heavy.1.raw 37232
ctatgcgccttgccagcccgctcagacagtatataggaagtagtccttgaccaggcagccagggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgagcgcccttcacggagtctccgtagaaagtgacaccaccagctccgatacttgagacccactccagtcccctccctggagcccggcggacccaggtcatgccataggcactaaggtgaatccagaggccgcacaggagagggtcagggacctcccaggccgatcaggcccccccagactccaacaactgcacttcacacacgacaccctttaaaaaagccacaagaaaaggcagctcagcccaaactccatggagacttctctctgttcggtcctggtcacaaatgaagacacctgaaatcccagggctgggctcctctctcagagctcccctttccctttatgcgactactaaatcgagcaccggtcgtgtatatactgtctgatggcgcgagggaggcgatacg

SEQ ID NO: 791761 - DNA, 695 bp, Homo sapiens
  misc_feature: 37243.UNK.UNK.UNK.pb.heavy.1.raw 37243
ctatgcgccttgccagcccgctcagacagtatataggaagtagtccttgacaggcagcccagggccgctgtgctctcggaggtgctcctggagcagggcgccaggggaagaccgatgggccctggtggaggctgaggagacggtgaccagggttccctggccccagtggacagttcctgatataaaacacaacacaataatacatgccgtgtcctcggtttcaggttagtcattcgcagaatcaatgagttcttgaagtcatctcttgagagggtgaatctggctttcacagacgcggcgtactctgtgataaagctggcaactttgttttactgcggcaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaggaaaaccagctcagccgaactccatggtgagtcctctgtgttcagtgctgatcaccaatgaaaacacctgggaattctgggctggggctccgctctcagagctccccaagagagatcgtgacgcagcttaatcgagcaaccggtcgtgtatatactgtctgatggcgcgagggaggcgatacg

SEQ ID NO: 791762 - DNA, 688 bp, Homo sapiens
  misc_feature: 37257.44.55.E11.1.pb.heavy.1.raw 37257
cgtatcgcctccctcgcgcatcagacagtatatcacgaccggtgctcgatttagcactcgcacgttgggttgggagaggagcccagcactgggattccgagtgtttcattcggtgatcagcactgaacacagaggactcaccatggagttttggctgagctgggttctccttgttggacttttaaaaggtgtccagtgtgagtgcggctgatggagtctggaggaggcttagtccagcctggggggtccagagactctcctgtgcagcctctgggctcacgtcagcagcaactacatgagttgggtccgccaggctccagggaaggggctggagtggtctcagtcatttatactggtgatttcacatactacgcagactccgtgaagggccgattcaccatctccagggacaattccaggaacacgggtttatcttcaaatgaacaacctgagaggcgacgacacggccgtctattacgtgtcgagacaagtcggcgctcggagtggttattattcgtttgacttctggggccagggaccctggtcaccgtcgcctccgcctccaccaagggcccatcggtcttccctggcacctcctccaagagcacctctggggcacagcggccctgggctgcctggtcaaggactacttcctatatactgtctgagcgggctgcaaggcgcatag

SEQ ID NO: 791763 - DNA, 704 bp, Homo sapiens
  misc_feature: 37269.44.55.E11.1.pb.heavy.1.raw 37269
cgtatcgcctccctcgcgccatcagacagtatatacacgaccggtgctcgatttagcactcgcacgttgggtttggggagaggagcccagcactgggattcccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctggctcaccgtcagcagcaactacatgagttgggtccgccaggctccagggaaggggctggagtgggtctcagtcatttatactggtgatttcacatactacgcagactccgtgaagggcgattcaccatctccagggacaattccaggaacacggtttatcttcaaatgaacaacctgagaggccgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791764 - DNA, 604 bp, Homo sapiens
  misc_feature: 37277.UNK.UNK.UNK.pb.heavy.1.raw 37277
aggctgggcaggctatgcaccctggtccaggtcaaaagctgcggaacccgctagcggccatctggccactaggggtcccgcagattcatattgtcgtctagcatgcacaattgctgcaaacccagcttgcatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctattttcctatcccatcccctaggatctcaattaagttactagcgagtaaatgtctgtagcgatccgtcagtcctatcgcgcgcatcaagacctggttggttgagcgtgcagtagatcatcgataagctgcgagttaggtcatcccagaccgcatctggcgcctaaaacgttcagtggtagctaaggcgtcaccttcgactgtctaaaggcaatatgtcgtccttagctcaagtccctagcaagcgtgtcggg

SEQ ID NO: 791765 - DNA, 677 bp, Homo sapiens
  misc_feature: 37310.44.45.E01.1.pb.heavy.1.raw 37310
cgtatcgcctccctcgcgccatcagacagtatatacacgaccggtgctcgatttagtgagtcagtaagggaaaggggctgggagaggagccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtcctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacacgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccagagcacctccgagagcacagcggccctggctgcctggtcaaggactacttcctatatactgtctgagcgggctggcaaggcgcatag

SEQ ID NO: 791766 - DNA, 575 bp, Homo sapiens
  misc_feature: 37370.44.78.H01.1.pb.heavy.1.raw 37370
cgtatcgcctccctcgcgccatcagacagtatatacacgaccggtgctcgatttagtgtgagtagtttgggtttgggttgccgaagttgctggaggtcacggtcaccacgctgctgaggtgagaagcctggggcctcagtgacagtcttcctgcacggcttctggatacacgttcatcaattatgatattaactgggtgcgacaggccgctggacaagggctggagtggatgggatggatgaagccctatagtggcaacacgggctttgcccagaaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791767 - DNA, 693 bp, Homo sapiens
  misc_feature: 37435.44.73.G07.1.pb.heavy.1.raw 37435
cgtatcgcctccctcgcgccatcagacagtattatacacgaccggtgctcgatttagctctacgctcaggggggagacgagcccagcactggaagtcgccggtgttttccattcggtgatcatcactgaacacagaggactcaccatggactttgggctgagatgggttttcctcgttgctcttttaagaggtggccagtgtcaggtgcagctagtggagtctgggggaggagcggccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791768 - DNA, 711 bp, Homo sapiens
  misc_feature: 37513.44.55.E11.1.pb.heavy.1.raw 37513
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaacccgtgttcctggaattgtccctggagatggtgaatcggcccttcacggagtctgcgtagtatgtgaaatcaccagtataaatgactgagacccactccagccccccttccctggagcctggcggacccaactcatgtagttgctgcctgacggtgagcccagaggctgcacaggagagtctctggacccccccaggctggactaagcctcctccagactccatcagccgcacctcacactggacaccttttaaaagtccaacaaggagaacccagctcagccaaaactcccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgaggggaggcgatacg

SEQ ID NO: 791769 - DNA, 738 bp, Homo sapiens
  misc_feature: 37537.UNK.UNK.UNK.pb.heavy.1.raw 37537
ctatgcgccttgccagcccgctcagacagtatataggaagtagtccttgaccaggcagcccaggcccggctgtgcccccagaggtgctcttggaggagggtgccagggggaagaccgatgggcccttggtggaggctgaggagacggcgaccgtggtcccttggccccaggcgtccataccattggagtagagcatgtcatatctgtatccaccgaggccccatctctcgcacagtagtagacagccgtgtcctcggctctcaggctattcatttccagatatagtgtgttcttcgaattgtctctggagatggtgaatcggcccttcacggaatctacataatatttattacttccatcataccatataaagtggccacccactccagtcccttgcctggagcctggcggacccagtgcatgcccatgtctgttgaaaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttccggtgctgatcaccgactggaaacaccgccgacttctggtgctgggctcctctccagagctccccaaacccaacgactcactctaaatcgagcaccggtcgtgtatatactgtctgatggcggccgagggaggcgatacg

SEQ ID NO: 791770 - DNA, 658 bp, Homo sapiens
  misc_feature: 37552.44.12.B01.1.pb.heavy.1.raw 37552
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagtttcgtcaccaactactttgaccactgggccaggaaccctggtcaccgtctcctcagcctccaccaagggcccatcggtcttcccctggcaccctcctcagagcacctctggggcacagcggccctggctgcctggtcaaggactacttcctatatactgtctgagcgggctggcaaggcgcatag

SEQ ID NO: 791771 - DNA, 703 bp, Homo sapiens
  misc_feature: 37568.44.36.D03.1.pb.heavy.1.raw 37568
cgtatcgcctcctcccgcgccatcagacagtatatacacgaccggtgctcgatttagctgcgtcacgatctctcttggagctctcagagaggtgccttagcctggattccaaggcatttccacttgtgatcagcaatgaacacagaggactcaccatggagttggggctgcgctgggttttccttgttgctattttagaaggtgtccactgtgagtgcggctggtggagtctgggggaggctggtacagcggggggggtcctgagactctcctgtgcagcctctggattcatcttcagtgactatgccatgaactgggtccgccaggctccaggaagggggctggagtgggtttcatatgttaatattgctggagataccacctactacgcagactctgtgaagggccgattcaccaattccagggacaatgccaagaactccacgtatctggaaatgaacagcctgagagacgaggacacggctgtctacttctgttcgagagatcgggccactggtcagtggctggtttgactactgggcccgggaaccctggtcaccgtctcctcagcctccaccaagggccatcggtcttcccctggcgccctgctcaggagcacctcgaggagcacagcggccctgggctgcctggtcaaggactacgttcctatatactgtgctgagcgggctggcaaggcgcatag

SEQ ID NO: 791772 - DNA, 696 bp, Homo sapiens
  misc_feature: 37580.UNK.UNK.UNK.pb.heavy.1.raw 37580
ctatgcgccttgccagcccgctcagacgtattaggagtagtccttgaccaggccagcccagggccgctgtgccccccagaggtgctctggagagggtgccagggggaagacgatggcccctggtggagcggaggcgacggtgaccagggttccctggcccagaagtcaacgaataataacactccgagcgccgacttgtctcgcacagtaatagacggccgtgtcgtcgcctctcaggttgttcatttgaagataaaccgtgttcctggaattgtccctggagatggtgaatcggcccttcacggagtctgcgtgtatgtgaaatcacgagtataaatggactgagacccactccagccccttccctggagcctggcggacccaccatgtagttgctgctgacggtgagcccagaggcctgcacaggagagtctctgggacccccccccaggctggactaagcctcctccagactccatcagccgcacctcacactggacaccttttaaaagtccaacaaggagaacccagctcagccaaaactcatggtgagtcctctgtgttcagtgctgatcaccgaatggaaacacctcgaatccagtgctgggctcctctccccccccaacccaacgtgcgagtgctaaatcgagcacccggtcgtgtatatactgtctgatggcgcgaggaggcgatacg

SEQ ID NO: 791773 - DNA, 688 bp, Homo sapiens
  misc_feature: 37589.UNK.UNK.UNK.pb.heavy.1.raw 37589
cgtatcgcctccctcgcgccatcagacagtatatacacgaccggtgctcgattttgatcacataacaaccacactcctcctctaaagaagcccctgggagcacagctcatcaccatggactggacctggcggttcctctttgtggtggcagcagctacaggtgttccagtcccaggtgcagctggtgcagtctggggctgaggtgaagaagcctgggtccttcgtgaaggtctcctgcaaggcttctggaggcaccttcttcagctatgcttttatttggtgcgacaggccctggacaagggcttgagtggctggagggatcatccctatctttggtgcatcgaattacgcacagaagtttcaggacagagtcaccattaccgcggacgaatccacgagtacagcctacatggagctgagcaggctgaagatctgaagacacggccatctatttctgtgcgagagcctcgtcaactttcatagtccctctcatagtcccacacatggaaattggttcgaccctggggccagggaactccggtcaccgtctcctcagctccaccaagggcccatcggtcctttccccctggcgcctgctccaggagcacctctgggcacagcggccctgggctgcctggtcaaggactactttcctatatactgtctgagcgggctgcaaggcgcatag

SEQ ID NO: 791774 - DNA, 567 bp, Homo sapiens
  misc_feature: 37604.UNK.UNK.UNK.pb.heavy.1.raw 37604
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttcctggcccacaagtcaagccaggtgctggtggctctcgcacagaaatacacggccgtgtcccagatctcaggctgctcagttccatgtagactgtacctggggaggtgctcctggtcatactaactctgcttggaactttctggggcaaagcccgtgttgccactatagggcttcatccatcccatccactccaggcccttgtccagcggcctgtcgcacccagttatatcataattgatgaacgttgtatccagaagccgtgcaggagactgtcactgaggccccaggcttcttcacctcagcagccgtggtgaccgtgacctccagcacttcgcacccaaaccaaactactcacactaaatcgagcacggtcgtgtatatctgtctgatggcgccgaggaggcgatacg

SEQ ID NO: 791775 - DNA, 713 bp, Homo sapiens
  misc_feature: 37629.44.55.E11.1.pb.heavy.1.raw 37629
cgtatcgcctccctcgcgccatcagaccagtaatatcacacgaccggtgctcgatttagcactcgcacgttgggtttggggagaggagcccagcactgggattccgaggtgtttccattcggtgatcaagcactgaacacagaggactcaccatggagttttggctgagctgggttctccttgttggacttttaaaaaggtgtccagtgtgaggtgcgggctgatggagtctggaggaggcttagtccagcctggggggtcccagagactctcctgtgcaagcctctgggctcaccgtcagcagcaactacatgagttgggtccgccaggctccagggaaggggctggagtggggttcagtcatttatactggtgatttcacatactaacgcagactccgtgaagggccgattcaccatctccagggacaatttccaggaacacggtttatcttcaaatgaaacaacctgagaggcgacgacacggccgtctattactgtgcgagacaagtcggcgctcggagtggttattattcgtttgacttctggggccagggaaaccctggtcaccgtcgcctccgcctccaccagggcccatcggtcttccccctggcaccctcctccaagaagcacctctggggcacagcggccctgggctgcctggtcaaggactacttcctatatactgtctgagcgggctggcaaggcgcatag

SEQ ID NO: 791776 - DNA, 685 bp, Homo sapiens
  misc_feature: 37650.44.53.E09.1.pb.heavy.1.raw 37650
cgtatcgcctccctcgcgccatcagacagtatatacacgaccggtgctcgatttagagagagtgtgttgagcctgggagaggagccccagccttggattcccaggtgttttcattcagtgatcaggactgaacacagaggactcaccatggagtttgggctgagctggattttccttgctgctattttaaaaaggtggtccagtgtgaggtgcagttggtggaagtctggggaggtttggtaaagcctggggagtcccttagactctcctgtgcagcctctggattcactttcagtaaacgcctggatgacctgggtccgccaggctccagggaaggggctggagtgggttggccgtattagaaccaagctgacggtgggacagcagactacgctgcacccgtgaaaggcagattcaccatctcaagagatgattcaaaagatacggtgtctctgcagatgaacagcctgaaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggcttgcctggtcaaggactacttcctatatactgtctgagcgggctggcaaggcgcatag

SEQ ID NO: 791777 - DNA, 710 bp, Homo sapiens
  misc_feature: 37652.UNK.UNK.UNK.pb.heavy.1.raw 37652
ctatgcgcctgccagcccgctcagacagtattataggaagtagtccttgaccaggcagcccagggccgctgtgctctcggaggtgctctggagcagggcgccagggggaagaccgatgggccttggtggaggccgaggagacggtgacgagggtccctgccccaggcgtcgaatgaacgatttggaaaccagatagtctcgcacaaaatacaccggccgtgtcctgaggtctcaggctgttcatttgaagagacactgtgttctcggaattgtctctggagatggtgaatccggccctccaacggaatcaccgtagacttgatttcctccatgaaatgacacacctgccacccactccagccctcgcctggaagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactcccatggtgagtcctctgtggttcagtgatgatcaccgagtggaaaccaccggcgacttccagtgctgggctcgtctcccagggcccccaaacccttcgatcgccgtctaaaatcgagcaccggtcgtggtatatactgtctgatggcgcgagggaggcgatacg

SEQ ID NO: 791778 - DNA, 627 bp, Homo sapiens
  misc_feature: 37669.UNK.UNK.UNK.pb.heavy.1.raw 37669
cgtatcgcctccctcgcgccatcagacagtatatcacaccggtgctcgatttagtagtgtaattccgcggggctttctgagagtcatggacctcctgtgcaagaacatgaagcacctgtgttcttcctcctgctggtgcggctcccagatgggtcctgtcccgctgcagctgcaggagtcgggccaggactggtgaagccttcggagaccctgtccctcacctgcactgtctctggtggctccatagcagtagtagttactactggggctggatccgcagcccagggaagggctggagtggtggagtatctattatagtggagcacctactacaacccgtccctcaagagtcgagtcacatattcagtagacacgtccaagaaccagtttctccctgagctgagctctgtgaccgccgcggacacggccgtgtattacgtgcgagagtagggcagttcgtcaccaactacttgaccactgggccagggaaccctggtcaccgtctctcagtccaccagggccatcgtctcctggcaccctcctccagagcacctctggggcacagcgccctgggtccgtggtcaagggacacttccttatactgtctgcggctggcaaggcgcatag

SEQ ID NO: 791779 - DNA, 710 bp, Homo sapiens
  misc_feature: 37704.44.55.E11.1.pb.heavy.1.raw 37704
cgttcgcctcctcgcgccatcagacagtatatacacgaccggtgctcgatttagcactcgcacgttggttttgggggagaggagcccagcaactgggattccgaggtgtttccattcgggtgatcagcactgaacacagaggactcaccatggagttttggctgagctgggttctccttgttggacttttaaaaggtgtccatgtgtcgaggtggcggctgatggagtcctggagaggggcttagtccagcctgggggtcccagagactctcctgtgcagcctctggccgctcaccggtcagcagcaaactacatgagttgggtccgccaggcccaggaaaggggctggaggggtctcagtcatttatactggtgaatttcacatactacgcagactccgtgaagggccattcaccatctccagggacaattccaggaacacggtttatcttcaaatgaacaacctgagaggcgacgacacggccgtctattactgtgcgagacaagtcggcgctcggagtggttattattcgtgttgacttcttggggccagggaaccctggtcaccgtcgctccgcctccaccaaagggcccatcggtcttccctggcaccctcctccaagagcacctctggggcacagcggccctgggctgcctggtcaaggactacttcctatatactgtctgagcgggctggcaaaggcgcatag

SEQ ID NO: 791780 - DNA, 611 bp, Homo sapiens
  misc_feature: 37706.UNK.UNK.UNK.pb.heavy.1.raw 37706
ccgacacgcttgctagggacttgggagctaaggacgacatattgcctttagacagtcgaaggtgacgccttagctaccactgaacgtttaggcgccagatgcggggtctgggatgacctaactcgcagcttatcgatgatctactgcacgctcaaccaaccaggtcttgatgcgcgcgataggactgacgggatcgctacagacatttaactcgctagtaacttaaattgagatcccaggggatgggataggaaatagaatccacccctaatcaccccccacatagcctgcttgggtgttgagtttacttttatttcgtgttggaatgagttgaacttccgggaagtggagtaatgggtttgtctacttcccctaaccgcaaagtactgttttacgagtggcgcgtgcaagccatagccagtcacaggtaataaacaattcaacgtggcgtaaagattggccgcttgctgtgggcattgcaagctgggtttggcagcattgtgcatgctagacgacaatatgaatctgcgggaccctagtggccaagatggccgctagcgggttccgcagctttttgacctggaccagggtgcatagcctgcccagccttc

SEQ ID NO: 791781 - DNA, 655 bp, Homo sapiens
  misc_feature: 37749.44.23.C01.1.pb.heavy.1.raw 37749
ctatgcgccttgccagcccgctcagacagtatataggaagtagtccttgaccaggcagccagggccgctgtgcccccagaggtgctcctggaggcagggcgccagggggaagaccgatgggcccttggtggaagctgaggagacagtgaccagggtgccacggccccatagattgaaagaccagtctcgcctcgcacagaaataaaacggccgtgtccgcggcggtcacggaggtcagtttcaggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctggcagctgcacctgggacaggacccatctgggagctgccaccagcaggaggaaaaaccacaggtgcttcatgttcttgcacaggaggtccttgactctcagaaagccccccaatccctaatcacgtgtactaaatcgagcaccggtcgtgtatatactgtctgatggcgcgagggaggcgatacg

SEQ ID NO: 791782 - DNA, 702 bp, Homo sapiens
  misc_feature: 37760.44.55.E11.1.pb.heavy.1.raw 37760
cgtatcgcctccctcgcgccatcagacagtatatacacgaccggtgctcgatttagcactcgcacgttgggtttgggggagaggagcccagcactgggattcgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgaagacaagtcggccgctcggagtggttattattcgtttgacttctggggccagggaaccctggtcaccgtcgcctccgcctccaccaagggcccatcggtcttccccctggcaccctcctccagagcacctctgggggcacagcggccctggctgcctggtcaaggactacttcctatatactgtctgaggcgggctggcaaggcgcatag

SEQ ID NO: 791783 - DNA, 671 bp, Homo sapiens
  misc_feature: 37763.44.71.G05.1.pb.heavy.1.raw 37763
ctatgcgccttgccagcccgctcagacagtatataggaagtagtccttgaccaggcagcccagggccgctgtgcccccagaggtgctctggaggagggtgccaggggaagaccgatgggcccttggtggaggctgaggagacggtgaccggggtccctttgccccagacgtccatgtagtagtaatacttgtattgttgtaacttctgcgaccctctggcacagtaataaagggccgtgtcgtccactcgcaggctcttcatctgcagaaacaccgtattcttggaattgtccctggagacgatgaagcggcccttcacggagtctgcgacattgtggcactaccaccagtaatggatgagacccactccagccccttccctggggcctgacggacccagatcatggcataggtattaaggcgaatccagaggctgcacaggagagtgtcagggaccccccggctgtaccaagcctcccccccgactccaacagctgcacttcacactggacaccttttaaaacagccacaagaaaaagccagctcagcccaaactccatgggagttctctctgttcagtccccagggctgggctcctctctcttgcgacgacactaaatcgagcaccggtcgtgtatatactgtctgatggcgccgagggaggcgatacg

SEQ ID NO: 791784 - DNA, 714 bp, Homo sapiens
  misc_feature: 37778.UNK.UNK.UNK.pb.heavy.1.raw 37778
ctatgcgccttgccagcccgcctccagaccagtatataggaagtagtccttgaccaggcagcccagggcccgctgtgctctcggaggtgctcctggagcaggggcgccaggggaagaccgatggcccttggtggaggctgaggagacggtgaccagggtcccctggccccagtcatgcgcccggtaataactactaccacctcccgatctcgcaccagtaatacagagcgagtcctcgactctcaggctgaccatttccaagtacacaatgttccgggaattgtctctggagatggtgaatcggcccttcacggagttctgcataatattcagaacttccatcatgtgctataactgccaaccactcggccccttgcctggagcctggcggacccagtgcatgccagaaccactgaaactaaatccagaggcttcacaggagagtctcagggacctccaggctggaccacgcctcccacagactccaccaggtgccacctgacagtggacacctcttaaaagagcaacgaggaaaacccagctcagcccaaactccatggtgagtcctctggtgttcagtgctgatcaccgaatggaaacaccgccgacttctagtgctgggctcctctcccagacccctttccttcacactacactaaatcgagcaccggtcggtggtatatactgtcctgatggcgcgagggaggcgatacg

SEQ ID NO: 791785 - DNA, 702 bp, Homo sapiens
  misc_feature: 37784.44.55.E11.1.pb.heavy.1.raw 37784
cgtatcgcctccctcgcgccatcagacagtatatacacgaccggtgctcgatttagcactcgcacgttgggtttggggggggagaggagcccagcattgggattccgagtgtttccattcggtgatcagcactgaacacagaggactcaccatggagttttggctgagctgggttctccttgttggactttaaaaaggtgtccagtgtgaggtgcggctgatggagtctggaggaggcttagtcagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggttttatcttcaaatgaacaacctgagaggcgacgacacggccgtctattactgtgcgagacaagtcggcgctcggagtgggttattattcgtttgacttctggggccaggaaccctggtcaccgtcgcctccgcctccaccaaggcccatcggtcttcccctggcaccctcctccaagagcacctctggggcacagcggccctgggctgcctggtcaaggactacttcctatatactgtctgaggggctggcaaggcgcatag

SEQ ID NO: 791786 - DNA, 697 bp, Homo sapiens
  misc_feature: 37790.UNK.UNK.UNK.pb.heavy.1.raw 37790
ctatgcgccttgcagcccgctcagacagtatataggaagtagtccttgaccaggcagcccagggccgctgtgccccagaggtgctcctggagcaggcgccaggggaagacgatgggcccttggtggaagctgaagagacggtgaccattgtccctggcccaaatatcaaatgcatcgacgtcccaggatcgcctggcgcagtatagagcgctgtgtcgtcgggtctcaggttgctcattgtaaatggccaacactgttggagtcatccttgagacggtgaatcttcccttcacagacgcggcgtactctttacttccaccataacgtttcattctgacgaagtgatccactcaagccccttccctggagcctgacggaccaggccaagtgataatcactaagactgaatcctgagactacacaggagagtctcagagaccgccctggctgtgtcagccccccccgactccgccagtcgcccctcgcactggacaccttctaaaaaaactacaaggaaatcaagattagcccaaactccatggttggtggtctgtgctcagtgctgatcaccaagtggaaactcctggaatctcacggctggggctcctctccagagctcccctttgtgtgttcagacgtctgctaaatcgagcacggtcgtgtatatactgtctgatggcgcgagggaggcgatacg

SEQ ID NO: 791787 - DNA, 695 bp, Homo sapiens
  misc_feature: 37859.UNK.UNK.UNK.pb.heavy.1.raw 37859
cgtatcgcctccctcgcgccatcagacagtatatacacgaccggtgcttcgatttagtgagtcagtaagggaaaggggctgggagaggagcccagcactagaaagtcggcggtgtttccattcggtgatcagcactgaacaacagaaggactcaccatggagttttgggctgagctgggttttcctcgttgctcttttaagaggtgtccagtgtcaggtttcagctggtggagtctgggggaggcgtggtccagcctgggacgtccctgagactctcctgtgttgcgtccggactcagttttcagtgacttctgccatgcactgggtccgccaggctccaggcaaggggctggagtgggtggcagtcatctggtctgatggaaagtaaagaatactatggaaactccgtgaagggccgattctccgtctccagagacaattccaaagaacaccgtgtatctacaaatgaacaatttgagagccgaggactcggctctctattattgtaacgagcccatcgttctactggggccagggagccctggtcaccgtctcctcagcctccaccaagggcccatcggtcttccccctggcgccctgctccagggagcacctccgagagcacagcggccctgggctgcctggtcaaggactacttcctatatactgtctgagcgggctggcaaggcgcatag

SEQ ID NO: 791788 - DNA, 688 bp, Homo sapiens
  misc_feature: 37861.44.62.F07.1.pb.heavy.1.raw 37861
cgtatgcctccctcgcgccatcagacagtatatacacgaccggtgctcgattagtagtcgcataaaggaaaggggagctctgagagaggagccagcctgggattttcagtgtcttcatttggtgaccaggaccgaacagagagaagtctccatggagtttgggctgagctgcctttttcttgtggctttttaagggtgtcgtgtgtgaagtgcagttgttggagtctggggggcctgattcgcctgggaggtccctgaccctctcctgtgcggctctggattcacctttagtgcctatggcatgactgggtccgccggctccagggaggggactggagtggtctcaagtatcggagctggtggtgtcactttctacggagactccgtgagggccgcttcaccatttccagggacaattcgcaggacaaattgtttctccaaatgaaaaacctgagacccgaggacacaggcgtctattactgtttgaaagccaggaccacggtgacccccatgacacctttagtacttggggccggggacagtggtgaccgtctcttcagcctccaccaagggcccatcgtcttcccctgcgccctgctcaggagcacctcgagagcacagcgccctgggctgcctggtcaaggactactttctatatactgtctgagcgggctggcaaggcgcataa

SEQ ID NO: 791789 - DNA, 724 bp, Homo sapiens
  misc_feature: 37874.44.86.H09.1.pb.heavy.1.raw 37874
ctatgcgccttgccagcccgctcagacagtatataggaagtagtccttgaccaggcagcccagggccgctgtgccccagaggtgctcttggaggagggtgccaggggaagaccgatgggcccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcaggacctcccaggctggaccacgcctcccccagactccaccagcttcactgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 791790 - DNA, 676 bp, Homo sapiens
  misc_feature: 37875.44.6.A06.1.pb.heavy.1.raw 37875
cgtatcgcctccctcgcgccatcagacagtatatacacgaccggtgctcgatttagatctactgacaaccacattcctcctctaaagaagcccctgggaggcacagctcatcaccatggactggacctggaggttcctctttgtggtggcagcagcaacaggtgtccagtccctggtgcaactggtgcagtctgggactagaatgccgcaaccttggtcctcggtgaccctttcctgcacgcctctggaagtactaccagttccactacttataccatcaactgggtgcgccaggcccctggacaagggctgaagtggatgggtggaatcatccctcttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtctttccccctggcgccctgctccaggagcacctctggggggcacagcggccctgggctgcctggtcaaggactacttcctatatactgtctgagcgggctggcaaggcgcatag

SEQ ID NO: 791791 - DNA, 650 bp, Homo sapiens
  misc_feature: 37878.44.23.C01.1.pb.heavy.1.raw 37878
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctcaggagcacctctgggggcacagcggccctgggctgcctggtcaaggactacttcctatatactgtctgagcgggctggcaaggcgcatag

SEQ ID NO: 791792 - DNA, 599 bp, Homo sapiens
  misc_feature: 37883.UNK.UNK.UNK.pb.heavy.1.raw 37883
aggctgggcaggctatgcaccctggtccaggtcaaaagctgcggaaacccgctagcggccatcttggccactaggggtccgcagattcatattgtcgtctagcatgcacaatgctgcaaacccagcttgcaatgcccacagcagcggccaatctttacgccacgttgaattgtttattacctgtgactggctatgcttgcaacgccactcgtaaactagtactttgcggttagggaagtagacaaacccatttactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggtggttgagcgtgcagtagatcatcgataagctgcgagttaggtcatcccagaccgcatctggcgcctaaacgttcagtggtagctaaggcgtcaccttcgactgtctaaggcaatatgtcgtccttagctccaagtccctagcaagcgtgtcgg

SEQ ID NO: 791793 - DNA, 682 bp, Homo sapiens
  misc_feature: 37885.UNK.UNK.UNK.pb.heavy.1.raw 37885
ctatgcgccttgccagccgctcagacagtatataggaagtagtcttgaccaggcagccaggccgctgtgctctcgaggtgctcctgagcaggcgccagggggaagaccgatggccttggtggagccgagagacggtgaccagggttcctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggaccactgcatattccaattatcgaaggtgaatccagaggctgcacaggagagtctcaggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacacggcgacttccagtgctgggctcgtctccagcccaaaccttcgatcgcgtctaaatcgagcaccgtcgtgtatatacttctgatggcgcgagggaggcgatacg

SEQ ID NO: 791794 - DNA, 673 bp, Homo sapiens
  misc_feature: 37949.44.45.E01.1.pb.heavy.1.raw 37949
cgtatcgcctccctcgcgccatcagacagtatatacacgaccggtgctcgatttagtgagtcagtaagggaaagggctggagaggagcccagcactagaagtcggcggtgtttccattcggtgatcagcactgaacacagaggactcaccatggagttgggctgagctgggttttcctcgttgctcttttaagaggtgtccagtgtcaggtcagctggtggagtctgggggaggcgtggtccagcctggacgtccctgagactctcctgtgttgcgtccggacttcagtttcagtgactctgccatgcactggtccgcaggctccaggcaagggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggcctctctattattgtacgagccatcgttctactgggccagggagccctggtcaccgtctctcagcctccaccaaggcccatcggtcttccccctggcgcctgctccaggagcacctccgagagcacagcggccctgggctgctggtcaagactacttcctatatactgtctgagcgggctggcaaaggcgcatag

SEQ ID NO: 791795 - DNA, 607 bp, Homo sapiens
  misc_feature: 38034.UNK.UNK.UNK.pb.heavy.1.raw 38034
cccgaccacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccagtcttgatgcgcgcgataggactgacgggatcgctacagacatttaactcgctagtacttaattgagatcctaggggatgggataggaaataggaatccacccctatcaccccccacatagcctgcttgggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacatttcaacgtggcgtaaagattggccgcttgctgtgggcattgcaagctgggtttgcagcattgtgcatgctagacgacaatatgaatctgcgggacccctagtggccaagatggccgctagcgggtttccgcagcttttgacctggaccagggtgcatagcctgcccagccttc

SEQ ID NO: 791796 - DNA, 697 bp, Homo sapiens
  misc_feature: 38039.44.84.H07.1.pb.heavy.1.raw 38039
ccagcccgctcagacagtatataggaagtagtccttgaccaggcagcccagggccgctgtgccccccagaggtgctcttgagaggtgccaggggaagaccgatgggcccttggtgaggctgcggcgacggtgaccagggctccctggccccaggagttgaaccacccacccactgtggatccagtcccccccctcttcgcacagaaataaagggccgtgtcttcgactctcaggctgttcatttccagaaaagtgtgtttccggaattgtctctggagatggtgaagcggcccttcacggactctcgcgtagtatgtgtcagttgcactagcgccaattgtcgagaacccactcgagccccttccctggagcctggcggacccaggtcatggcatagctcctaaaggggaagccagaggctgcacaggagagtctcaggacccccaggctgtgccaatcctcccccagactccaacagggccacctcacactggacaccttttaaaatagtcacaagaaaaagccacctcagcccaaactccatggtgagttctctctgttcagtcctgaatcaccaaatgaaaacacctgaaaatcccagggctgggctctctctcagagctccccgcgacagacgtctgctaaatcgagcaccggtcgtgtatatactgtctgatggcgcgagggaggcgatacg

SEQ ID NO: 791797 - DNA, 607 bp, Homo sapiens
  misc_feature: 38051.UNK.UNK.UNK.pb.heavy.1.raw 38051
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatcttacgccacttgaattgtttattacctgtgactggctatggcttgcaacgccactcgtaaaactagtactttgcgggttaggggaagtagacaaacccattactccacttcccggagttcaactcatttccaacacgaaataaaagtaaactcacacccaagcaggctatgtgggggggtgataggggtggattctattcctatcccatccctaggatctcaattaagtactagcgatttttaaatgttctgtagcgatcccgtcagtcctatcgcgcgcatcaagagcctggttggattgagcgtgcagtagatcatcgataagctgcgagtttaggtcatcccagaccgcattctggcgccctaaacgtcagtggtagctaaggcgtcaccttcgactgtctaaagcatatgtcgttccttagctccaagtccctagcaagcgtgtcggg

SEQ ID NO: 791798 - DNA, 689 bp, Homo sapiens
  misc_feature: 38064.44.36.D03.1.pb.heavy.1.raw 38064
cgtatcgcctccctcgcgccatcagacagtatatacacgaccggtgctcgatttagctgcgtcacgatctctcttgggagctctgagagcggagcccagccccagaattcccaggtgtttcattggtgatcagcactgaacacagaggactcaccatggagttcgggctgagctggttttccttgttgttattttacaaggtgtccagagtgaagtgcagtggtggagtccgggggagacttggtccagcctggagggtcctgagactctcctgtgtcgccctctggattcaccatcagtgaccactatatggactggtccgccaggctccaggaagggctggagtggctggccgcagtaaaaacaaagttgccagctttatcacagagtacgccgcgtctgtgaaagccagattcaccctctcaagagatgacttcagaactcattgattctgcgaatgactaacctgaaaaccgaggacacgggcatgtattattgtgtgtgtttatatcaggaaactgtccactgggccagggaacctggtcaccgtctcctcagcctccaccaaggcccatcgtcttccccctggcgccctgctccaggagcacctccgaggcacagcggccctgggctgcctggtcaaggactacttcctatatactgtctgagcgggctggcaaggcgcatag

SEQ ID NO: 791799 - DNA, 697 bp, Homo sapiens
  misc_feature: 38066.44.55.E11.1.pb.heavy.1.raw 38066
ctatgcgccttgccagcccgctcagacagtatataggaagtagtccttgaccaggcagccagggccgctgtgcccccgaggtgctcttggaggagggtgccagggggaaagaccgatgggcccttggtggaggcggagcgacggtgaccaggttccctggccccagaagtcaaacgaataataaccactccgagcgccgacttgtctcgcacagtaatagacggccgtgtcgtcgcctctcaggttgttcatttgaagataaacgtgttcctggaattgtccctggagatggtgaatcggcccttcacggagtctgcgtagtagtgaaatcaccagtataaatgactgagacccactccagccccttccctggagcctggggacccaactcatgtagttgctgctgacggtgagcccagaggctgcacaggagagtctctgggaaccccccaggctggactaagcctcctccagactccatcagccgcacctcacactggacaccttttaaaagtccaacaaggagaaccagctcagccaaaactccatggtgagtcctctgtgttcagtgctgatcaacgaatggaaacacctcgaatcccagtgctgggctcctctccccccaaacccaacgtgcgagtgctaaatcgagcaccggtcgtgtatatactgtctgatggcgcgaggaggcgatacg

SEQ ID NO: 791800 - DNA, 667 bp, Homo sapiens
  misc_feature: 38073.44.86.H09.1.pb.heavy.1.raw 38073
cgtatcgcctccctcgcgccatcagacagtatatacacgaccggtgctcgatttagtgctatagacttgggtttgggggatgctttttctgagagtcaaggaccttcctgtgcaagaacatgaagcacctgtggttttttcctcctgctggtggcagctcccagaatgggtcctgtcccaggtgcagctgcaggagtcgggcccaggactggtgaggccttcgggaaccctgtctctcatctgcactggtctctggagtttccatcagttctgatcattcttggggctggatccggcagcccccagggagggggaatggagtggatttggtgacatccattatactggggcgacgtactactctccgtccctcaagagtcgtctcaccattttcgagggacacgtccatgaaccgctttctccctgaaactgacctccgtgaccgccgcggacacggccgttattttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactactttcctatatactgtctgagcgggctggcaaaggcgcatag

SEQ ID NO: 791801 - DNA, 635 bp, Homo sapiens
  misc_feature: 38081.44.23.C01.1.pb.heavy.1.raw 38081
cgtatcgcctccctcgcgccatcagtctatactatcacgaccggtgctcgatttagtacacgtgattagggattggggctttctgagagtcaaggacctcctgtgcaagaacatgaagcacctgtggtttttctcctgctggtggcagctccagatgggtcctgtcccaggtgcagctgcaggagtcgggccaggactggtgaggccttcggaaccctgtctctcatctgcactgtctctggagtttccatcagttctgatcatcttggggctggatccggcagcccccagggaggggaatggagtggattggtgacatccattatactgggcgacgtactactctccgtccctcaagagtcgtctcacatttcgaggacacgtccatgaaccgcttctccctgaaactgacctccgtgacgccgcggacacgccgtttattctgtgcgaggcgagactggtctttcaatctatgggccgtggcaccctggtcactgtctcctcagcttccaccaagggccatcgtcttcccctggcgccctgctccaggagcacctctggggcacagcggcctgggctgcctggtcaaggactacttcctatatactgtctgagcgggctggcaaggcgcatag

SEQ ID NO: 791802 - DNA, 590 bp, Homo sapiens
  misc_feature: 38093.44.78.H01.1.pb.heavy.1.raw 38093
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctgggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaacctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791803 - DNA, 699 bp, Homo sapiens
  misc_feature: 38105.44.62.F07.1.pb.heavy.1.raw 38105
ctatgcgccttgccagccgctcagacagtatataggaagtatccttgaccaggcagcccagggccgctgtgctctcgaggtgctcctggagcagggcgccagggaagaccgatgggcccttggtggaggctgaagagacggtcaccactgtcccccgcgcccaagtactaaaggtgtcatgggggtcaccgtggtcctgctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactcagtcccctccctgggcccggcggacccaggtcatgccataggcactaaaggtgaatccgaggccacacaggagagggtcagggacctcccaggcgaatcaggccccccccagactccaacaactgcacttcacacacgacacctttaaaaaagccacaagaaaaaggcagctcagcccaaactccatggagacttctctctgttcggtcctggtcaccaaatgaagacacctgaaaatcccaggctggctcctctctcagagctccctttccctttatatgcgactactaaatcgagcaccggtcgtgtatatactgtctgatggcgcgagggaggcgatacg

SEQ ID NO: 791804 - DNA, 598 bp, Homo sapiens
  misc_feature: 38113.44.36.D03.1.pb.heavy.1.raw 38113
cgtatcgcctccctcgcgccatcagtctatactatcacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatatagaatgggtgtgagctggatccgtcagccccagggaaggccctggagtggcttgcacacatcttctcgaatgacgaaaaatcctacagtacatctctgaagagcagtttaaccatctccaaggacacctccaaaggcaggtggtctttagtatgaccaacatggaccctgcggacacaggcacatattactgtgcacgggtaatgcggaaagaaacagctggttctgtattataagtcttaccatctgacgtctggggcaaagggaccacggtcaccgtctcctcagcttccacaagggcccatcggtcttcccctggcgccctgctccaggagcacctctggggcacagcggccctggctgcctggtcaaggactacttcctatatactgtctgagcgggctggcaaggcgcatag

SEQ ID NO: 791805 - DNA, 737 bp, Homo sapiens
  misc_feature: 38180.44.33.C11.1.pb.heavy.1.raw 38180
cgtatcgcctccctcgcgccatcagacagtatatacacgaccggtgctcgattttagagtgagctcgttgggtttgggggctgggagaggagcccagcaccagaagtcggcggtgttttccagtcggtgatcagcaccgaaacacagaggactcaccaatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattattgtagattccgtgaagggccgattcaccatctccagagacaaattcgaagaacacactatatctggaaatgaatagcctgagagccgaggacacggctgtctactactgtgcgagagatggggcctcgtggatacagatatgacatgctctactccaatggtatggacgcctggggccaagggacccacggtcgccgtctcctcagcctccaccaagggcccatcggtctttccccctggcaccctcctccaagagcacctctgggggcacagcggccctgggctgccctggtcaaggactacttcctatatactgtctgagcgggctggcaaggcgcatag

SEQ ID NO: 791806 - DNA, 657 bp, Homo sapiens
  misc_feature: 38203.UNK.UNK.UNK.pb.heavy.1.raw 38203
gtccttgaccaggccagcccagggccgctgtgctctcggaggtgctcctggagcagggcgccagggggaagaccgatgggcccttggtggaggccgaggagacggtgaccagggttcctggcccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcaggaccgcctactggccacgcctcccccagactcccgaattgcacctgacacatgacacctcttaagagggcaacgaggaaacccagctcagcccaaactccatggtggagtcctctgtgttcagtgatgatcaccgagtggaaacaccggcgacttccagtgctgggctcgtctcccagccccaaacccttcgatcgcgtctaaatcgagcacggtcgtggtatatactgtctgatggcgcgagggaggcgatacg

SEQ ID NO: 791807 - DNA, 615 bp, Homo sapiens
  misc_feature: 38209.UNK.UNK.UNK.pb.heavy.1.raw 38209
ctatgcgccttgccagcccgctcagacagtatataggaagtagtcctttgaccaggcagcccagggccgctgtgcccccagaggtgctcctggagcagggcgccaggggggaagaccgatgggcccttggtggaagctgaggagacggtgaccgtggtcccttttgccccagacgtccagatggtaagacttataaatacagaaaccagctgtttctttcccgcattacccgtgcacagtaatatgtgcctgtgtccgcagggtccatgttggtcatactaaagaccacctgcctttttggaggtgtcctttggagatggttaaactgctcttcagagatgtactgtaggatttttcgtcattcgagaagatgtgtgcaagccactccagggccttccctggggctgacggatccagctcacacccattcaatatcgttgagagagaacccagagatggtggcaggtcagcggagggtctctgtgggttttcaccagcacaggaccagactccttcaaggtgacctgggacaagacccaaagagagatcgtgacgcagcaaatcgagcaccggtcgttgtatatactgtctgatggcgccgagggaggcgatacg

SEQ ID NO: 791808 - DNA, 700 bp, Homo sapiens
  misc_feature: 38244.44.73.G07.1.pb.heavy.1.raw 38244
ctatgcgccttgccagccgctcagacagtatataggaagtagtccttgaccaggcagccagggccgcgtgctctcggaggtgctcctggagcagggcgccagggggaagacgatgggccttggtggaggctgaggagacggtgaccagtgtcccctggcccagtgaaacgcccgataatagctgctgccacttcccgatctcgcacagtaatacagagcgagtcctcgcctctcaggcctgatcatttccaggtacaggaggtgttccggggaattgtctctggagatggtgatcggcccttcacggagtctgcataatatctagaagttccatcatatgctataactgccaacactccggccccttgcctggagccctggcggacccagtgcatgccagaactactgaaactaaatccagaggcttcacaggagagtctcagggacctcccaggctggaccacgcctcccccagactcaccaggtgcacctgacactggacacctcttaaaagagtaacgagggaaaacccagctcagcccaaactccatggtgagtcctctgtgttcagtgctgatcaccgaatggaaacaccgccgacttctagtgctgggctcctctccagagctcccctgagcgtagagctaaatcgagcaccggtcgtgtatatactgtctgatggcgcgagggaggcgatacg

SEQ ID NO: 791809 - DNA, 639 bp, Homo sapiens
  misc_feature: 38255.44.23.C01.1.pb.heavy.1.raw 38255
gtatcgcctcctcgcgccatcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtccaggtgcagctgcaggagtcgggcccaggactggtgaggccttcggaaacctgtctctcatctgcactgtctctggagtttccatcagttctgatcattcttgggctggatccggcagcccccagggagggaatggagtggattggtgacatccattatactggggcgacgtactactctccgtccctcaagagtcgtctcaccatttcgagggacacgtccatgaaccgcttctccctgaactgacctccgtgaccgccgcggacacggccgtttatttctgtgcgaggcgagactggtctttcaatctatggggccgtggcaccctggtcactgtctctcagcttccaccaagggcccatcgtcttcccctggcgccctgctccaggagcacctctggggcacagcggccctgggctgcctggtcaaggactacttcctatatactgtctgagcggctgcaaggcgcatag

SEQ ID NO: 791810 - DNA, 665 bp, Homo sapiens
  misc_feature: 38263.44.71.G05.1.pb.heavy.1.raw 38263
ctatgcgcctgccagcccgctcagacagtatataggaagtagtccttgaccaggcagcccagggccgctgtgccccagaggtgctcttggaggagggtgccagggggaagaccgatgggcccttggtgaggctgaggagacggtgaccgggtccctttgccccagacgtccatgtagtagtaatacttgtattgttgtaacttctgcgaccctctggcacagtaaataaaggccgtgtcgtccactcgcaggctcttcatctgcagaaacaccgtattcttgaattgtccctggagacgatgagcgcccttcacggagtctgcgacatttgtggcactaccaccagtaatggatgagacccactccagcccttccctggggcctgacggaccagatcatggcataggtattaaaggcgaatccagaggctgcacaggagagtgtcaggaacccccccggctgtaccaagcctcccccgactccaacagctgcacttcacactggacaccttttaaaacagccacaagaaaaagccagctcagcccaaactccatggtgagttctctctgttcagtccccagggctggcccctctctcttgcgacgacactaaaatcgagcaccggtcgtgtatatactgtctgatggcgcgagggaggcgatacg

SEQ ID NO: 791811 - DNA, 655 bp, Homo sapiens
  misc_feature: 38267.44.86.H09.1.pb.heavy.1.raw 38267
ctatgcgccttgccagcccgctcagacagtatataggaagtagtccttgaccaggcagcccagggcccgctgtgccccagaggtgctcctggagcagggcgccagggggaagaccgatgggcccttggtggaagctgaggagacagtgaccagggtgccacggcccatagattgaaaagaccagttctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 791812 - DNA, 695 bp, Homo sapiens
  misc_feature: 38276.UNK.UNK.UNK.pb.heavy.1.raw 38276
ctatgcgccttgccagccctcagacagtatataggaagtagcttgaccaggcagcccaggcgcgtgctctcggaggtgctcctgagcagggccagggagaagaccgatggcccttggtggaggctgaggagacggtgaccagggttcctggccccagtgacagttcctgatataaacacaacacaataatacatgcccgtgtcctcggttttcaggttagtcattcgcagaatcaatgagttcttgaagtcatctcttgagaggggtgaatctggctttcacagaccgcgcgtactctgtgataaagctggcaactttgttttactgcggccaagccactccagcccttcccctggagcctggcggacccaagtccatatagtggtcactgatggtgaatccagagcggacacaggagagtctcagggaccctccaggctggaccaagtctcccccggactccaccaactgcacttcactctggacaccttgtaaaataacaacaaggaaaaaacccagctcaggccccgaactccatggtgagtcctctgtgttcagtgctgatcaccaaatgaaaacacctgggaattctgggggctgggctccgctctcagagctccccaagagagatcgtgacgcagctaaatcgagcaccgtcgtgtatatactgtctgatggcgcgaggaggcgatacg

SEQ ID NO: 791813 - DNA, 604 bp, Homo sapiens
  misc_feature: 38324.UNK.UNK.UNK.pb.heavy.1.raw 38324
aggctgggcaggctatgccacctggtccaggtcaaaagctgcggaacccgctagcggccatcttggccactaggggtccgcagattcatattgtcgtctagcatgcacaatgctgcaaacccagcttgcaatgcccacagcaagcggccaatctttacgccacgtttgaattgtttattacctgtgactgggtatggcttgcaacgccactcgtaaaactagtactttgcggtagggaagtagacaaacccattactccacttccggaagttcaactcattccaacacgaaataaaagtaaactcaacaccccaagcaggctatgtgggggggtgataggggtggattctatttcctatcccatcccctaggatctcaattaagttactacgagtttaaaatgtctgtagcgatcccgtccagtcctaatcgcgcgcatcaagacctgttggttgaagcggcagtagatcatcgataagctgcgagttaggtcatcccagaccgcatctggcgcctaaacgttcagtggtagctaaggcgtcaccttcgactgtctaaaggcaatatgtcgtccttagctcaagtccctagcaagcgtgtcggg

SEQ ID NO: 791814 - DNA, 707 bp, Homo sapiens
  misc_feature: 38329.44.62.F07.1.pb.heavy.1.raw 38329
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaaggtgtcatggggtcaccgtggtcctggctttcaaacagtaatagacgcctgtgtcctcggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggcccccccagactccaacaactgcacttcacacacgacacctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 791815 - DNA, 694 bp, Homo sapiens
  misc_feature: 38332.UNK.UNK.UNK.pb.heavy.1.raw 38332
cgctccctcgcgcatcagtacagtatattgacacgaaccggtgctcgatttagcactcgcacgttgggtttgggggagaggagccacactggggattccgaggtgtttccattcggtgatcagcatgaacagagacctcccatggagttttgctgagctgggttctcttgttggacttttaaaggtgtccagtgtgaggtgcggctgatggagtctggaggaggcttagtccagcctgggggggtcccagagactctcctgtgcaggctctggctcacccgtcagcagcaactacatgagttggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactggtgcgagacaagtcggcgctcggagtggttattattcgtttgacttctggggccagggaaccctggtcaccgtcgcctccgcctccaccaagggcccatcggtcttcccccctggcaccctcctccaagagcacctctgggggcacagcggcccctgggctgcctggtcaaggactacttcctatatactgtctgagcgggctgcaaggcgcatag

SEQ ID NO: 791816 - DNA, 720 bp, Homo sapiens
  misc_feature: 38342.44.33.C11.1.pb.heavy.1.raw 38342
cgtatcgcctccctcgcgccatcagacagtatatacacgaccggtgctcgatttagagtgagctcgttgggtttggggctggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtcctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatgggctcgtggatacagatatgacatgctctactccaatggtatggacgcctggggccaagggaccacggtcgccgtctcctcagcctccacaagggcccatcggtcttcccctggcaccctcctccaagagcacctctgggggcacagcggccctgggctgcctggtcaaggactacttcctatatactgtctgagcgggctggcaaggcgcatag

SEQ ID NO: 791817 - DNA, 685 bp, Homo sapiens
  misc_feature: 38353.UNK.UNK.UNK.pb.heavy.1.raw 38353
cgtatcgcctccctcgcgccatcagacagtatatacacgacggtgctcgatttagacgcgatcgaagggtttgggctgggagacgagcccagcactgaagtcgccggtgtttcactcgtgatcatcactgaacacagaggactcaccatggagtttggctgagctggttttcctcgttgccctcttaagaggtgtcatgtgtcaggtgcaattcgtgagtctgggggaggcgtggcccagtagggggtccctgagactctcctgtgcagcctctggattcaccttcgataattggaatatgcagtggtccgccaggctccaggcgaggggctgagtggtggcaggtgtgtcatttcatggaggaaatcaagtctacggtgattccgttgagggccgattcaccatctccagagacaattcgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttcccctggcgccctgctccaggagcacctccgagagcacagcggcctggctgcctggtcaaggactacttcctatatactgtctgagcggctggcaaggcgcatag

SEQ ID NO: 791818 - DNA, 708 bp, Homo sapiens
  misc_feature: 38354.UNK.UNK.UNK.pb.heavy.1.raw 38354
ctatgcgccttgccagccgctcagacagtatataggaagtagtccttgaccaggcagccagggccgctgtgctctcggaggtgctcctggagcagggcgccagggggaagaccgatgggcccttggtggaggccgaggagacggtgaccagggttccctggccccaggcgtcgaatgaaccgattttggaacagatagtctcgcacaaaaatacacggcgtggtcctgaggtctcaggctgttcatttgaagagacactgtgttctcggaattgtctctggagaatggtgaatcggccctcaacggaatcaccgtagacttgatttcctccatgaaatgacacacctgccacccactccagcccctcgcctggagcctggcggacccactggcatattccaattatcgaaggtgaatccagaggctgcacaggagagtctcaggacccccctactgggggccacgcctcccccagactcacgaattgcacctgacacatgacacctcttaagagggcaacgaggaaaacccagctcagcccaaactccatggtgagtcctcctgtgttcagtgatgatcaccgagtggaaacaccggcgacttccagtgctggctcggtctctcccagcccaaacccttcgatcgcgtctaaatcgagcagcaccggtcgtgtatatactgtctgatggcgccgagggaggcgatacg

SEQ ID NO: 791819 - DNA, 701 bp, Homo sapiens
  misc_feature: 38362.44.55.E11.1.pb.heavy.1.raw 38362
ctatgcgccttgcagcccgcttcagacagtatataggaagtagtccttgaccaggcagccaggccgctgtgccccagagtgctcttggaggagggtgccaggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttccaggaattgtccctggagatggtgaatcggcccttcacggagtctgcgtagtatgtgaaatcacagtataaatgactgagacccactccagccccttccctggagcctggcggacccaactcatgtagtttgctgctgacggtgagcccagaggctgcacaggagagtctctgggacccccaggctggactaagcctcctccagactccattcagccgcacctcacactggacaccttttaaaagtccaacaaggagaacccagctcagccaaaactccatgggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgccgagggaggcgatacg

SEQ ID NO: 791820 - DNA, 669 bp, Homo sapiens
  misc_feature: 38369.UNK.UNK.UNK.pb.heavy.1.raw 38369
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagctttcagggagaactggttcttggacgtgtctactgatatggtgactcgactcttgagggacgggttgtagtaggtgcctcccactataatagatactcccaatccactccagcccccttccctggggggctggcggatccagcccccagtagtaactactactgctgatggagccaccagagacagtgcaggtgagggacagggtctccgaaggcttcaccagtcctggcccgactcctgcagctgcagctgggacaggacccatctgggagccgccaccagcaggaggaagaacccacaggtgcttcatgttcttgcacaggaggtccatgactctcagaaagcccccgcggaatctacactactaaatcgagcacggtcgtgtatatactgtctgatggcgcgagggaggcgatacg

SEQ ID NO: 791821 - DNA, 641 bp, Homo sapiens
  misc_feature: 38384.UNK.UNK.UNK.pb.heavy.1.raw 38384
cgatcgcctcctcgcgccatcagacagtatatacacgacggtgctcgatttagtgtagtgtgaagggaaaggggactcctgtgccccaccatggacacacttgctccacgctcctgctgcctgaccatcccttcatgggcctgtcccagatcaccgtgaaagagtctggccctacattggtgaaacccacacagacccttcacgctgacctgcaccgtctcaggcttctcactcgtcactcctggagagggcgttgtctgggtgcgggcagccccggaaaggccctggagtggatcgcactcacttattggaatgacgatatacgatatagtccttctctgacgaccagactcacgctcacgaaggacaacgcaaaaaccaggtggtcctttacattgaccaacgtggaccctgtgacacaggccacatattctgtgcccacttcatgaccacatgaccacggcttcttcgaaccctgggcccagggaatccaggtcaccgtctcatcagcctccacaagggcccatcggtcttcccccctggcgccctgcccaggagcacctccgagagcacagcggcctggctgcctggtcaaggactacttcctatatactgtctgagcgggctggcaaggcgcatag

SEQ ID NO: 791822 - DNA, 692 bp, Homo sapiens
  misc_feature: 38396.UNK.UNK.UNK.pb.heavy.1.raw 38396
cgtatcgcctccctcgcgcccatcagacagtatatcacgacgccggtgctcgatttagctctacgctcagcgggagacgagcccagcactggaagtcgccggtgtttccattcggtgatcatcactgaacacagagacgtcaccatgactttgggctgagatgcggtttttcctcgttgcttcttttaagaggtggccagtgtcaggtgcagctagtggagtctggggaggagcggccagcctggaactccctgagactctcctgtgcaggcctctggattcatctcaggacctatgcccatgcactgggtccgccaggctccaggcaaggggctggagtgggtggcaattatatcagaagatggaattgaacgaacactacggagactccgagaagggccgatcaccgtctccagagacaattccaggaacacactgcatctgcaaatgtacaacctcacaagtgaggacacggcctgtctattattgtgcgagaccccctcgagacggtccccgcttgactactggggccagggaacccttggtcaccgtctcctcagcctccaccaagggccatcgtcttccccctggcgccctgctccaggagcacctcgagagcacagcggccctgggcctgcctggtcaaggactacttccgctatatactgtctgagcggctggcaggcgcatag

SEQ ID NO: 791823 - DNA, 703 bp, Homo sapiens
  misc_feature: 38419.44.55.E11.1.pb.heavy.1.raw 38419
cgtatcgcctccctcgcgccatcagacagtatatacacgaccggtgctcgatttagcactcgcacgttgggtttggggagaggagccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791824 - DNA, 580 bp, Homo sapiens
  misc_feature: 38427.44.78.H01.1.pb.heavy.1.raw 38427
cgtatcgcctccctcgcgccatcagacagtatatacacgaccggtgctcgatttagtgtgagtagtttggtttgggggaagaggaagactgacggtcccactcccaggtacagctgtgcagtctggggctgaggtgaagaagcctgggcctcagtgacagtctcctgcacggcttctggatacacgttcatcaattatgatattaactgggtgcgacaggccgctggacaagggctggagtggatggatggatgaagccctatagtggcaacacggctttgcccagaagttccaagcagagttagtatgaccaggagcacctccccaggtacagtctacatggaactgagcagcctgagatctgaggacacggccgtgtatttctgtgcgagagccaccagcacctggcttgacttgtggggccaggaaccctggtcacgtctcctcagcctccaccaagggccatcggtcttcccctggcgccctgctcaggagcacctccgagagcacagcggccctgggctgcctggtcaaggactacttcctatatactgtctgagcgggctggcaaggcgcatag

SEQ ID NO: 791825 - DNA, 712 bp, Homo sapiens
  misc_feature: 38444.UNK.UNK.UNK.pb.heavy.1.raw 38444
atcgcctcccctcccccccgccgccatcagacagtatatacacgaccggtgctcgatttagctgcgtccacgatctctcttggggagctctgagagcggagcccccagccccagaatcccaggtgttttcatttggtgatcagccactgaacacagaggactcaccatggaggttcgggctgagctgggttttccttgttgttattttacaaggtgtccagagtgaagtgcagttggtggagtcgggggagacttggtccagcctggagggtccctgagactctcctgtgtcgcctctggattcaccatcagtgaccactatatggactgggtccgccaggctccagggaaggggctggagtggctgccgcggcagtaaaaacaaagttgccagctttatcacagagtacgccgcgtctgtgaaagccagattcaccctctcaagagatgacttcaagaactcattgattctgcgaatgactaacctgaaaaccgaggacaacggcatgtattattgtgttgtgtttatatcaggaactgtccactggggccagggaacccctggtcaccgtctcctcagcctccaccaagggcccatcggtcttccccctggcgccctgctccagggcacctccgagagcacagcggccctgggctgcctggtcaaggactactcctatatactgtctgagcgggctggcaaggcgcatag

SEQ ID NO: 791826 - DNA, 678 bp, Homo sapiens
  misc_feature: 38515.44.36.D03.1.pb.heavy.1.raw 38515
cagtatataggaagtagtccttgaccaggcagcccagggccgctgtgctccggaggtgctcctggagcagggcgccagggggaagaccgatgggcccttgtggagctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaacccactccagccccttccctggagccctggcggacccagttcatggcatagtcactgaagatgaatcagaggctgcacaggagagtctcagggacccccccgcctgtaccaagcctccccagactccaccagccgcacctcacagtggacaccttctaaaatagcaacaaggaaacccagcgcagccccaactccatggtgagtcctctgtgttcagtgctgatcacaagtggaatgccttggaatccagggctaaggcacctctctgagagctcccaagagagatcgtgacgcagctaaatcgagcaccggtcgtgtatatactgtctgatggcgcgagggaggcgatacg

SEQ ID NO: 791827 - DNA, 646 bp, Homo sapiens
  misc_feature: 38527.UNK.UNK.UNK.pb.heavy.1.raw 38527
ctatgcgccttgccagcccgctcagacagtatataggaagtagtcttgaccagcagccagggccgctgtgcccccagaggtgctcttggagggggtgccaggggaagaccgatgggccctggtggaggctgaggagacggtgaccagggttccctggccccagtggtcaaagtagttggtgacgaaactgccctactctcgcacagtaatacacggccgtgtccgccggcggtcacagagctcagcttcagggagaactggttcttggacgtgtctactgatatggtgactcgactctgaggacgggttgtagtaggtgctcccactataatagatactccaatccactccagcccttccctgggggctggcggatccagcccagtagtaactactactgctgatggagccacagagacagtgcaggtgagggacagggtctccgaggcttcaccagtcctgggcccgactctgcagctgcagctggacaggacccatctggagccgccaccagcaggaggaagaaccacaggtgcttcatgttcttgcacaggaggtccatgactctcagaaagccccgcggatctacactactaaatcgagcacggtcgtgtatatactgtctgatgcgcgaggaggcgatacg

SEQ ID NO: 791828 - DNA, 700 bp, Homo sapiens
  misc_feature: 38549.UNK.UNK.UNK.pb.heavy.1.raw 38549
cgtaatcgcctccctccgcccatcagacagtatatacacgacggtgctcgatttagcactcgcacgttggtttgggagaggagccagcactggattccgaggtgttccattcggtgatcagcactgaacacagaggactcaccatggagttttttggctgagctgggttctccttgttggacttttaaaaggtgtccagtgtgaggtgcggctgatggagtctggagaggcttagtccagcctggggggtcccagagactctcctgtgcagcctctgggctcaccgtcagcagcaactacatgagttggtccgccaggctccagggaaggggctggagtgggctcagtcatttatactgtgatttcacatactaacgcagaactccgtgaagggccgattcaccatctccagggacaattccagggaacacggtttatcttcaaatgaacaacctgagaggcgacgacacggcccgtctattactgtgcgagacaagtcggcgctcggagtgggtattattcgtttgacttctggggccagggaaccctggtcaccggtcgcctccgcctccaccaaggcccatcggttcttccctggcaccctcctccaagagcacctctggggcacagcggccctgggctgcctggtcaaggactacttgcctatatactgtctgaagcgggctggcaaggcgcatag

SEQ ID NO: 791829 - DNA, 651 bp, Homo sapiens
  misc_feature: 38559.44.86.H09.1.pb.heavy.1.raw 38559
cgtatcgcctccctcgcgccatcagacagtatatacacgaccggtgctcgatttagtgctatagacttgggttggggatgctttctgagagtcaaggacctcctgtgcaagaacatgaagcacctgtggttttttcctcctgctgtggcagcttcccagatgggtcctgtcccaggtgcagctgcaggagtcgggcccaggactggtgaggccttcgggaaccctgtctctcatctgcactgtctctggagtttccatcagttctgatcatttctggggctggatccggcagcccccagggaggggaatggagtggattggtgacatccattatactggggcgacgtactactctccgtccctcagagtcgtctcaccatttcggaggacacgtccatggaaaccgcttctcctgaaactgacctccgtgaccgccgcggacacggccgtttatttctgtgcgaggcgagactggtctttcaatctatgggggcgtggcaccctggtcactgtctcctcagcttccaccaagggcccatcggtcttccctggcgccctgctccaggagcacctctgggcacagcggccctgggctgcctggtcaaggactacttcctatatactgtctgagcgggctggcaaggcgcatag

SEQ ID NO: 791830 - DNA, 709 bp, Homo sapiens
  misc_feature: 38566.44.56.F01.1.pb.heavy.1.raw 38566
ctatgcgccttgccagcccgctcagacagtatataggaagtagtccttgaccaggcagccagggccgctgtggccccagaggtgctcctggagcagggcgccagggggaagaccgatgggcccttggtggaagctgaagagacggtgaccattgtccctggcccaaatatcaaatgcatcgacgtcccaggatcgcctggcgcagtaatagacgcctgtgtcgtcgggtctcaggttggctcatttgtaaatggccaacactgttggagtcatcccttgagacgcgtgaatcttcccttcacagacgcggcgtactctttacttccaccataacgtttcattctgacgaaagtgatccactcaagccccttccctggagcctgacggacccaggccaagtgataatcactaagactgaattctgagactacacaggagagtctcagagaccgccctggctgtgccaaggcccccccccgactccgccagtcgcccctcgcactggacaccttctaaaaaaactacaaggaaatcaagattagcccaaactccatggttggtggtctgtgctcagtgctgatcaccaagtggaaactcctgggaatctcacggctggggctcctctccagcccctttgtgtgttcagacgtctgctaaatcgagcaccggtcgtgtatatactgtctgatggcgcgaggggggcgatacg

SEQ ID NO: 791831 - DNA, 676 bp, Homo sapiens
  misc_feature: 38575.44.6.A06.1.pb.heavy.1.raw 38575
ctatgcgccttgccagcccgctcagacagtatatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgcccaccacaaagaggaacctccaggtccagtccatggtgatgagctgtggctcccagggcttctttagaggaggaatgtggttgtcagtagatctaaatcgagcaccggtcgtgtatatactgtctgatggcgcgaggaggcgatacg

SEQ ID NO: 791832 - DNA, 657 bp, Homo sapiens
  misc_feature: 38594.44.53.E09.1.pb.heavy.1.raw 38594
cgtatcgctccctcgcgccatcagacagtatatacacgaccggtgctcgattagagagagtgtgttgagctctgggagaggagcccagccttggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctgggagtccttagactctcctgtgcagctctggattcactttcagtaacgcctggatgacctggtccgccaggctccagggaaggggctggagtgggttgccgtattagaaccaaagctgacggtggacagcagactacgctgcacccgtgaaaggcagattcaccatctcaagagatgattcaaaagatacggtgtcctctgcagatgacagcctgacacgaggacacagcgtctattactgtctgggatggtttcattcggccagggaaccctggtcactctcctctcagctccacagggcccatcgtcttcccctggcgccctgctccaggagcacctcgagagcacagcgccctgggctgcctgtcaagactacttctatatactgtctgagcgggctgcaaggcgcatag

SEQ ID NO: 791833 - DNA, 581 bp, Homo sapiens
  misc_feature: 38624.44.78.H01.1.pb.heavy.1.raw 38624
tgccagcccgctcagacagtatataggaagtagtccttgaccaggcagcccagggccgctgtgctctcggaggtgctcctggagcagggcgccagggggaagaccgatggccccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtggctcctggtcatactaactctgccttggaacttctgggcaaagcccgtgttgccactatagggcttcatccatcccatccactccagcccttgtccagcggcctgtcgcacccagttaatatcataatgatgaacgtgtatccagaagccgtgcaggagactgtcactgaggccccaggcttcttcaccctcagccccagactgcaccagctgtacctgggagtgggaccgtcagtcttcctcttcccccaaacccaaactactcacactaaatcgagcaccggtcgtgtatatactgtctgatggcgcgaggaggcgatacg

SEQ ID NO: 791834 - DNA, 649 bp, Homo sapiens
  misc_feature: 38632.44.86.H09.1.pb.heavy.1.raw 38632
cgtatcgcctccctcgcgccatcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggatggtgacatccattatactggggcgacgtactactctccgtccctcaagagtcgtctcaccatttcgaggacacgtccatgaaccgcttctccctgaaactgacctccgtgacgcgccggacacggccgtttatttctgtgcgaggcgagactggtctttcaatctatggggccgtggcaccctggtcactgtctcctcagcttcaccaagggcccatcgtcttccccctggcgccctgctccaggagcacctctgggggcacagcggccctgggctgcctggtcaaggactacttcctatatactgtctggagcgggctggcaaggcgcatag

SEQ ID NO: 791835 - DNA, 693 bp, Homo sapiens
  misc_feature: 38652.44.74.G08.1.pb.heavy.1.raw 38652
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgatagtatagactgatggcgcgaggggaggcgatacg

SEQ ID NO: 791836 - DNA, 681 bp, Homo sapiens
  misc_feature: 38680.UNK.UNK.UNK.pb.heavy.1.raw 38680
cgtatcgcctccctcgcgccatcagacagttatatacacggaccggtgcctcgatttagagagagtgtgttgagctctgggagaggagccccagccttgggattcccaggtgttttcattcagtgatcaggactgaacacggaggactcaccatggagtttgggctgagctggattttccttgctgctatttaaaaggtgtccagtgtgaggtgcagttggtggagtctgggggagtttggtaaagcctggggagtcccttagactctcctgtgcagcctctgattcactttcagtaacgcctggatgacctgggtccgccaggctccaggaaggggctggagtgggttggccgtattagaaccaagctgaccggtgggacagcagactacgctgcacccgtgaaaggcagattcaccatctcaagagatgattcaaaagatacggtgtctctggcagatgaacagcctgaacaccgagacacagccgtctattactgtctgggatggttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791837 - DNA, 705 bp, Homo sapiens
  misc_feature: 38686.44.67.G01.1.pb.heavy.1.raw 38686
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaaccgtgttcctggaattgtccctggagatggtgaatcgcccttcacggagtctgcgtagtatgtgaaatcaccagtataaatgactgagacccactccagccccttccctggagcctggcgacccaactcatgtagttgctgctgacggtgagcccagaggctgcacaggaagagtctctgggacccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggctcctctccccccaaacccaatatgtatactctaaatcgagcaccggtcgtgtatatactgtcttgatggcgcgagggaggcgatacg

SEQ ID NO: 791838 - DNA, 728 bp, Homo sapiens
  misc_feature: 38715.UNK.UNK.UNK.pb.heavy.1.raw 38715
ctatgcgccttgccagcccgctcagacagtatataggaagtagtccttgaccaggcagcccaggccgcgtgcccccagaggtgctcttggaggagggtgccagggggaagaccgatggcccttggtggaggctgaggagaccggtgaccgtggtccccttggccccagacgtccataccgtagtagtagtcccagcaggtggtagtactacaatatgtcctcgcacagtaatacacagcccgtgtctcggctctcaggctgttcatttgcagatacagcgtgtcttggaattgtctctgagatggtgaatcggccttcacggagtctgcatagtatttattacttccatcatccatataagtgccacccactccagccccttgcctggagcctggcggacccagtgcatgccataggtaactgaaggtgaatccagacgctgcacaggagagttctcaggacctccccaggctggaccacgcctcccccagactccaccagctgcacctgacactggacacctcttaaaaagagcaacgaggaaaacccagctcaggcccaaactttccatggtgagtcctctgtgtgttcagtgcgtgatcaccggaatggaaacaccggtccgaacttctagtgctgggcctcctgctccccccgccgactgagtgatactaaatcgagccaccggtccgtgtatatactgtctgatggcgcgaggaggcgatacg

SEQ ID NO: 791839 - DNA, 601 bp, Homo sapiens
  misc_feature: 38752.UNK.UNK.UNK.pb.heavy.1.raw 38752
gaaggctgggcaggctatgcaccctggtccaggtcaaagctgcggaacccgctagcggccatctggccactaggggtccgcagattcatattgtcgtctagcatgcacaatgctgcaaacccagcttgcaatgcccacagcaagcggccaatctttacgccacgtgaattgtttattacctgtgactggctatggcttgcaacgccactcgtaaaactagtacttgcggttaggggaagtagacaaacccattactccacttcccggaagttcaactcattccaacacgaaataaaagtaactcaacaccccaagcaggcatgtgggggggctgataggggtggattctatttcctatcccatcccctaggatccaattaagttactagcgagttaaatgtcgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaagggcaatatgtcgtccttagctccaagtccctagcaagccgtgtcggg

SEQ ID NO: 791840 - DNA, 717 bp, Homo sapiens
  misc_feature: 38765.44.55.E11.1.pb.heavy.1.raw 38765
cgtatcgcctccctcgcgccatcagacagtatatacacgaccggtgctcgatttagcactcgcacgttgggtttgggggggagcaggagcccagcactgggattccgcaggtgtttccattcggtgatcagcactgaacacagaggactcaccatggagtttgggctgagctggcgttctccttgttgacttttaaaaggtgtccagtgtgaggtgcggctgatggagtctggaggaggcttagtccagcctgggggcggtcccagagactctcctgtgcagcctctgggctcaccgtcagcagcaactacatgagttgggtccgccaggctccagggaagggggctggagtcgggtctcagtctttatactccggtgatttcacatactacgcagactccgtgaagggccgattcaccatctccaggacaattccagggaacacggtttatcttcaaaatgaacaacctgagaggcgacgacacggcccgtctattactgtgcgagacaagtcggccgctcggagtggttattattcgtttgacttctggggccagggaaccctggtcaccgtcgcctccgcctccaccaagggccccatcggctttccccctggcaccctcctccaagagcacctctgggggcacagcggccctggctgcctggtcaaggactacttcctatatatactgtctgagcgggggctggcaaggcgca

SEQ ID NO: 791841 - DNA, 705 bp, Homo sapiens
  misc_feature: 38824.44.55.E11.1.pb.heavy.1.raw 38824
cgtatcgcctccctcgcgccatcagaagtatatacacgaccggtgctcgatttagcactcgcacgttgggtttggggagaggaggcccagcactgggattccgaggtgtttccattcggtgatcagcactgaacacagaggactcaccatggagttttggcctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtggggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 791842 - DNA, 705 bp, Homo sapiens
  misc_feature: 38833.UNK.UNK.UNK.pb.heavy.1.raw 38833
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagaacggtgaccagtgtcccctggccccagtgaaacgcccgataatagctgctgccacttcccgatctcgcacagtaatacagagccgagtcctcgcctctcaggctgatcatttccaggtacagagtgttccgggaatttgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctccccagactccaccaggtgcacctgacactggacacctcttaaaagagtaacgaggaaaaccagctcagccaaactccatggtgagtcctctgtgttcagtgctgatcaccgaatggaaacaccgccgacttctagtgctgggctcctctcccagagctcccctgagcgtaagagctaaatcgagcaccggtcgtgtatatactgtctgatggcgcgagggaggcgatacg

SEQ ID NO: 791843 - DNA, 698 bp, Homo sapiens
  misc_feature: 38840.44.36.D03.1.pb.heavy.1.raw 38840
cgtatcgcctccctcgcgccatcagacagtatatacacgaccggtgctcgatttagctgcgtcacgatctctcttggggagctctgagagcggagccccagccccagaattcccaggtgtttcattggtgatcagcactgaacacagaggactcaccatggagttcgggctgagctgggttttccttgttgttattttacaaggtgtccagagtgaagtgcagttggtggagtccgggggagacttggtccagcctggagggtcctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatctgtctgagcgggctggcaaggcgcata

SEQ ID NO: 791844 - DNA, 683 bp, Homo sapiens
  misc_feature: 38841.44.9.A09.1.pb.heavy.1.raw 38841
ctatgcgccttgccagcccgctcagacagtatataggaagtagtccttgaccaggcagccaggccgctgtgctctcggaggtgctcctggagcagggcgccaggggaagaccgatgggcccttggtggaggctgaggagacggtgaccagggttccctggccccagtagtcaagcggggaccgtctcgaggggctctcgcacaataatagacagccgtgtctcacttgtgaggttgtacattgcagatgcagtgtgtcctggaattgtctctggagacggtgaatcggccttctcggagtctccgtagtgttcttcaattccatcttctgatataattgccacccactccagcccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctgggctcgtctcccccctgcgcgtctcgctaaatcgagcaccggtcgtgtatatactgtctgatggcgcgagggaggcgatacg

SEQ ID NO: 791845 - DNA, 449 bp, Homo sapiens
  misc_feature: 38842.44.55.E11.1.pb.heavy.1.raw 38842
cgtatcgcctccctcgcgccatcagacagtatatacacgaccggtgctcgatttagcactcgcacgttgggtccgccaggctccagggaaggggctggagtggtctcagtcatttatactggtgatttcacatactacgcagactccgtgaaggccgatcaccatctccagggacaattccaggaacacgtttatcttcaaatgaacaacctgagaggcgacgacacggccgtctattactgtgcgagacaagtcggcgctcggagtggttattattcgtttgactctgggccaggaaccctggtcaccgtcgcctccgcctccaccaagggccatcggtcttccccctggcaccctcctccaagagcacctctgggcacagcggccctgggctgccggtcaaggactacttcctatatactgtctgagcgggctggcaaggcgcatag

SEQ ID NO: 791846 - DNA, 661 bp, Homo sapiens
  misc_feature: 38853.44.12.B01.1.pb.heavy.1.raw 38853
ctatgcgccttgccagcccgctcagacagtatattaggaagtagtccttgaccaggcagcccaggccgctgtgcccccagaggtgctcttggaggaggggtgccaggggaagaccgatgggccctggtgaggctgagagacggtgaccagggttcctggcccagtggtcaaaagtagttggtgacgaactgccctactctcgcacagtaatacacggccgtgtccgcggcggtcacagagctcagcttcagggagaactggttcttggacgtgtctactgattatggtgactcgactcttgagggacgggttgtagtaggtctccacttataatagatactcccaatccactccagcccttccctgggggctgcggaatccagcccagtagtaactactactgctgatggagccaccagagaccagtgcaggtgagggacaagggtctccgaaaggctttcaccagtccctgggcccgactctgcagctgcagctgggacaggacccatctgggagccgcacagcaggaggaagaacacaggtgcttcatgtttcttgcacagaggttccatgactctcagaaagccccccgcggaatctacactactaaatcgagcaccggtcgtgtatatactgtctgatggcgcgaggaggcgatacg

SEQ ID NO: 791847 - DNA, 715 bp, Homo sapiens
  misc_feature: 38857.44.86.H09.1.pb.heavy.1.raw 38857
cgtatcgccctcctccgcctacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaaggtgtccagtgtcaggtgaagctggtgagtctggggaggcgtggtccagcctgggaggtccctgagactctcctgtgtagcgtctggattcaccttcacagacatggcatgcactgggtccgccaggctccaggcaagggactggagtgggtggcacttatatggtatgatggaagtaataaaatattatgtagattccgtgaagggccgattcaccatctccagagacaattcgaagaacacactatatctggaaatgaatagcctgagaagccgaggacacggctgtctactactgtgcgagagatggggctcgtggatacagatatgacatgctctactccaatggtatggacgcctggggccaagggaccacggtcgcccgtctcctcagcctcccccaagggcccatcggtcttccccctggcaccctcctccaagagcacctctggggcacagcggccctgggctgcctggtcaaggactacttcctatatactgtctgagcgggctggcaaggcgcatag

SEQ ID NO: 791848 - DNA, 665 bp, Homo sapiens
  misc_feature: 38869.UNK.UNK.UNK.pb.heavy.1.raw 38869
ctatgcgccttgccagcccgctcagacagtatataggaagtagtccttgaccaggcagcccaggccgctgtgccccagaggtgctcttggaggagggtgccaggggaagaccgatggcccttggtggaggctgaggagacggtgaccgggtcctttgccccagacgtccatgtagtagtaatacttgtattgttgtaacttctgcgaccctctggcacagtaataaagggccgtgtcgtccactcgcaggctcttcatctgcagaaacaccgtattcttggaattgtccctggagacgatgaagcggcccttcacggagtctgcgacatttgtggcactaccaccagtaatggatgagacccactccagccccttcctggggcctgacggacccagatcatggcataggtattaaaggcgaatccagaggctgcacaggagagtgtcagggacccccccggctgtaccaagcctcccccgactccaacagctgcacttcacactggacaccttttaaaacagccacaagaaaaagccagctcagccaaactccatggtgagtctctctgttcagtccccagggctgggctcctctctcttgcgacgacactaaatcgagcaccggtcgttgtatatactgtctgatggcgcgaggaggcgatacg

SEQ ID NO: 791849 - DNA, 723 bp, Homo sapiens
  misc_feature: 38878.44.33.C11.1.pb.heavy.1.raw 38878
cgtatcgcctccctcgcgccatcagacagtatatacacgaccggtgctcgatttagagtgagctcgttgggtttggggagctctgggagaggagccagcaccagaagtcggcggtgtttccagtcggtgatcagcaccgaacacagagactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctgattcaccttcaacagacatggcatgcactgggtccgccaggctccaggcaaggactggagtgggtggcacttatatggtatgatggaagtaataaatattatgtagattccgtgaaggccgattcaccatctccagagacaattcgaagaacacactatatctggaaatgaatagcctgagagccgagacacggctgtctactactgtgcgagagatggggctcgtggatacagatatgacatgctctactccaatgtatggacgcctgggggccaagggaccacggtcgccgtctcctcagcctccaccaagggcccatcggtcttccccctggcaccctcctcaagagcacctctgggggcacagcgccctgggctgcctggtcaaggactacttcctatatactgtctgagcggggctggcaaggcgcatag

SEQ ID NO: 791850 - DNA, 704 bp, Homo sapiens
  misc_feature: 38918.44.56.F01.1.pb.heavy.1.raw 38918
cgtatcgcctcctcgcgccatcagacagtatatacacgaccggtgctcgatttagcagacgtctgaacacacaaagggagctctgggagaggagccccagccgtgagattcccaggagtttccacttggtgatcagcactgagcacagaccaccaaccatggagtttgggctaatcttgatttccttgtagtttttttagaaggtgtccagtgcgagggcgactggcggagtcgggggggcttggcacagccagggcgtctctgagactctcctgtgtagtctcaggattcagtcttagtgattatcacttggcctgggtccgtcaggctccaggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctggacgtcgatgcatttgatatttggggccagggacaatggtcaccgtctcttcagcttccaccaagggcccatcggtcttccccctggcgccctgctccaggagcacctctgggggcacagcggccctggctgcctggtcaaggactacttcctatatactgtctgagcgggctggcaaggcgcatag

SEQ ID NO: 791851 - DNA, 692 bp, Homo sapiens
  misc_feature: 38945.UNK.UNK.UNK.pb.heavy.1.raw 38945
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggctttcacagacgcggcgtactctgtgataaagctggcaactttgtttttactgcggccaagccactccagcccttccctggagcctggcgacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctggggctccgctctcccccagagagatcgtgacgcagctaaatcgagcaccgtcgtgtatatactgtctgatggcgcgagggaggcgatacg

SEQ ID NO: 791852 - DNA, 685 bp, Homo sapiens
  misc_feature: 38955.44.71.G05.1.pb.heavy.1.raw 38955
cgtatcgcctcctcgcgccatcagacagtatatacacgaccggtgctcgatttagtgtcgtcgcaagagagaggagccccagccgtgagattcccagggttccacttggtgatcagcactgagccagaccaccaaccatggagtttgggctaatcttgattttcttgtagtttttttagaggtgtccagtgcgaggggcgactgggcggagtcggggggggcttggcacagccagggcggtctctgagactctcctgtgtagtctcaggatcagtcttagtgattatcacttggcctgggtccgtcaggctccagggaaggggcttgagtggatcactttcgtcagaatgaaacgttatggtggaagtaaagagtacgccgcgtctgtgaagggaagattcacggctctcaagggatgactccaacagtgttggccatttacaaatgagcacctgagacccgacgacacaggcgtctattactgcgccaggcgatcctgggacgtcgatgcatttgatatttggggccaggggacaatggtcaccgtctcttcagcttccaccaagggcccatcgtcttcccctggcgccctgctccaggagccctctgggggcacagcggcctgggctgcctggtcaaggactacttcctatatactgtctgagcgggctggcaaggcgcatag

SEQ ID NO: 791853 - DNA, 726 bp, Homo sapiens
  misc_feature: 38973.44.33.C11.1.pb.heavy.1.raw 38973
ctatgcgccttgccagcccgctcagacagtatataggaagtagtccttgaccaggcagccagggccgctgtgcccccagaggtgctcttggaggagggtgccagggggaagaccgatgggcccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactcaccagcttcacctgacactggacacctcttaaaagagcaacgaggaaaacccaggtcagcccaaactccatggtgagtcctctgtgttcggtgctgatcaccgactggaaacaccgccgactttctggtgctgggctcctctcccagagctcccaaacccaacgagctcactctaaatcgagcaccggtcgtgttatactgtctgatggcgcgagggaggcgatacg

SEQ ID NO: 791854 - DNA, 642 bp, Homo sapiens
  misc_feature: 38978.UNK.UNK.UNK.pb.heavy.1.raw 38978
cgtatcgcctcctcgcgccatcagacagtatatacacgaccggtgctcgatttagtgctaagacttgggtttgggatgctttctgagagtcaaggacctcctgtgcaagaacatgaagcacctgtggttttcctcctgctggtggcagctcccagatgggtcctgtcccaggtgcagctgcaggagtcgggccaggactggtgaggccttcgggaacctgtctctcatctgcactgtctctggagttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttccccctggcgcctgctccaggagcacctctgggggccagcggccctgggcgcctggtcaaggactacttccatatactgtctgagcgggctggcaaggcgcatag

SEQ ID NO: 791855 - DNA, 644 bp, Homo sapiens
  misc_feature: 38989.UNK.UNK.UNK.pb.heavy.1.raw 38989
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacgccgtgtcgcggcggtcacggaggtcagtttcagggagaagcggttcatggacgtgtccctcgaaatggtgagacgactcttgagggacggagagtagtacgtcgcccccagtataatggatgtcaccaatccactcattcccctccctgggggctgccggatccagccccaagaatgatcagaaactgatggaaactccagagacagtgcagatgagagacagggttcccgaaggcctcaccagtcctgggccgactctgcagctgcacctggacaggacccatctgggagctgccaccagcaggaggaaaaaccacaggtgcttcatgttcttgcacaggaggtccttgactctcagaaagcatttcccttatgagactactaaatcgagcaccggtcgtgtatatactgtctgatggcgcgagggaggcgatacg

SEQ ID NO: 791856 - DNA, 645 bp, Homo sapiens
  misc_feature: 38994.UNK.UNK.UNK.pb.heavy.1.raw 38994
cgtatcgcctccctcggcgccatcagtctatactatcacgacggtgctcgatttagagagagtgtgttgggtttgggggaagcacctgtggttcttcctcctgctggtggcgggctccagatgggtcctgtctcagccgcagctgcgggagtcggccaggactggtgaagccttcgagaccctgtccctcacgtgcacggtctctggtgcctccatcgacagaagtaatttctactggggctggatcgcccagccccaggagaggggctgcagtggattgggagtctctattatagtgggaacacctactacaaccgtccctcaacggtcgagtcaccatatccgtggacacgtcgaggacacagtttccctgaaagtgagttctgtggccgccgccgacacggctgtctactactgtgtcagacatgggtccgcctatggcaggtcgtctcaattctactacgcttgggacgtctggggccaagggaccacggtcaccgtctcctcatcctcagcctccaccagggcccatcggtctttccccctggcgcctgctccaggagcacctcgagagcacagcggccctgggctgcctggtcaagctacttcctatatactgtctgagcgggctggcaaggcgcatag

SEQ ID NO: 791857 - DNA, 668 bp, Homo sapiens
  misc_feature: 39000.44.12.B01.1.pb.heavy.1.raw 39000
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtccctcacctgcactgtctctggtggctccatcagcagtagtagttactactggggctggatccgccagccccagggaaggggctggagtggattgggagtatctattatagtgggagcacctactacaacccgtccctcaagagtcgagtcaccatatcagtagaccacgtccaagaaccagttctccctgaagctgagctctgtgaccgccgcggacacggccgtgtattactgtgcgagagtagggcagttcgtcaccaactactttggaccactggggccagggaaccctggtcaccgtctcctcagcctccaccaagggcccatcggtcttccccctggcaccctcctccaagagcacctctgggggcacagcggccctgggctgcctggtcaagggactacttcctatatactgtctgagcgggctggcaaggcgcatag

SEQ ID NO: 791858 - DNA, 659 bp, Homo sapiens
  misc_feature: 39017.44.12.B01.1.pb.heavy.1.raw 39017
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcaggagtcgggcccaggactggtgaagccttcggagaccctgtccctcacctgcactgtctctggtggctccatcagcagtagtagttactactggggctggatccgccagccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagctccaccaagggccatcggtcttcccctggcaccctcctccaagagcacctctgggggcacagcggccctgggctgcctggtcaaggactacttcctatatactgtctgagcggctggcaaggcgcatag

SEQ ID NO: 791859 - DNA, 648 bp, Homo sapiens
  misc_feature: 39064.44.86.H09.1.pb.heavy.1.raw 39064
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacagtgcttcatgtcttgcacaggagggtcttgactctcagaaagcatcccaaacccaagtctatagcactaaatcgagcaccggtcgtgtatatactgtctgatggcgcgaggaggcgatacg

SEQ ID NO: 791860 - DNA, 750 bp, Homo sapiens
  misc_feature: 39067.UNK.UNK.UNK.pb.heavy.1.raw 39067
cgtatcgcctcctcgcgcccatcagacagtatgatacgcacgacagccggtggctcgatttagtagtcgcataaaggggaaaggggagctctgagagaggcagcccagccctgggattttcaggtgtcttcatttggtgaccaggaccgaacagagagaagtcttccatggagtttgggcctgagctggcgctttttcttgtggcttttttaaagggtgtcgtgtgtgaagctgcagttgttggagtctgggggggggcctgattcggcctgggaaggtccctgaccccctctcctgtgcgggcctctggattcacctttagtgcctatggcaatgacctgggtccgccgggctccagggaggggactggagtgcgggtcctcaagtatgcggagctggtggtgtcacctttctaccggagactcccgtgaaggggcccgcttcaccatttccaggggacaattcgcaggacaaattgtttctccaaatgaaaaacctgagacccgaggacacaggcgtctattactgtttgaaagccaggaccacggtgaccccccatgacacctttagtacttggggccgggggacagtggtgaccgtctcttcagcctccaccaaagggccccatcggtcttcccccctggcgccctgctccaggagcacctcccgagagcacagcggccctggggctgcctggtccaggaactacttcctatatactgtgtctgagcgggctggcaaggcgcatag

SEQ ID NO: 791861 - DNA, 718 bp, Homo sapiens
  misc_feature: 39074.44.56.F01.1.pb.heavy.1.raw 39074
cgtatcgcctccctcgcgccatcagacagtatatacacgaccggtgctcgatttagcagacgtctgaacacacaaaggggagctctgggagaggagccccagccgtgagattcccaggagtttccactggtgatcagcactgagcacagaccaccaaccatggagtttgggctaatcttgattttccttgtagtttttttagaaggtgtccagtgcgaggggcgactggcggagtcggggggggggcttggcacagccagggcggtctctgagacctctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctggcctggtcaaggactacttcctatatactgtctgagcgggctggcaaggcggcatag

SEQ ID NO: 791862 - DNA, 703 bp, Homo sapiens
  misc_feature: 39080.UNK.UNK.UNK.pb.heavy.1.raw 39080
ctatgcgccttgccagccgctcagacagtatataggaagtagtccttgaccaggcagccagggccgctgtgccccagaggtgctcttgaggagggtgccaggggaagacgatgggccttggtggaggctgagagacggtgaccgtggtccttggcccagacgtccataccgtagtagtagtccagcaggtggtagtactacaatatgtcctcgcacagtaatacacagccgtgtcctcggctctcaggctgttcatttgcagatacagcgtgttcttggaattgtctctggagatggtgaatcgcccttcacggagtctgcatagtatttattacttccatcataccatataagtgccacccactccagccccttgcctggagcctggcggaccagtgcatgccataggtactgaaggtgaatccagacgctgcacaggagagtctcagggacctccaggctggaccacgcctcccccagactcaccagctgcacctgacactggacacctcttaaagagcaacgaggaaaacccagctcagccaaactccatggtgagtcctctgtgttcagtgctgatcaccgaatggaaacaccgccgacttctagtgctgggctcctctccagagctcccgcgactgagtgatactaaatcgagcacggtcgtgtatatactgtctgatggcgcgagggaggcgatacg

SEQ ID NO: 791863 - DNA, 639 bp, Homo sapiens
  misc_feature: 39090.44.86.H09.1.pb.heavy.1.raw 39090
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagtctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgcctgctccaggagcacctctgggggcacagcggccctgggctgcctggtcaaggactacttcctatatactgtctgagcgggcct

SEQ ID NO: 791864 - DNA, 706 bp, Homo sapiens
  misc_feature: 39146.44.27.C05.1.pb.heavy.1.raw 39146
cgtatcgcctccctcgcgccatcagaccagtatatacacgaccggtgctcgatttagacgcgatcgaagggtttggggagccctgggagacgagccccagcactggaagtcgccggtgtttccactcgtgatcatcactgaacacagaggactcaccatggagtttgggctgagctgggtttcctcgttgccctcttaagaggtgtcatgtgtcaggtgcattcgtggagtctggggaggcgtggccccagtaggggtccctgagactctcctgtgcagcctctggattcaccttcgataattggaatatgcagtggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcagacacggccgtgtatttttgtgcgagactatctgtttccaaaatcggttcattcgacgcctggggccagggaaccctggtcaccgtctcctcggcctccgacgcaagggccgcatcggtcttccccctggcgccctgctccaggagcacctccgagagcacagcgcgccctgggctgcctggtcaaggactacttcctatatactgtctgagcgggctggcaaggcgcatag

SEQ ID NO: 791865 - DNA, 725 bp, Homo sapiens
  misc_feature: 39150.UNK.UNK.UNK.pb.heavy.1.raw 39150
cgtatcgccctccctcggcgccatcagacagtatataccgaccgaccggtgctcgatttagctgcgtcacgatctctcttgggggagagcggagccccagccccagaattccaggtgttttcatttggtgatcagcactggaacacagaggacttcaccatggagttcgggctgagctgggttttccttgttgttattttacaaggtgtccagagtgaagtgcagttggtggagtccgggggagactttggtccagcctggagggtccctgagactctcctgtgtcggctctgattcaccatcagtgaccactatatggaccccctccagggggtcggccaggctccaggggggggccggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttggtgtttatatcaggaaactgtccactggggccagggaaccctggtcaccgtctcctcagcctccaccaagcggcccatcggtcttccccctggcgccctgctccaggagcacctccgaagcagcacaagcggccctgggctgcctggtcaaggactacttcctatatactgtctgagcgggctgggcaaggcgcatag

SEQ ID NO: 791866 - DNA, 738 bp, Homo sapiens
  misc_feature: 39153.44.85.H08.1.pb.heavy.1.raw 39153
ctatgcgccttgccagcccgctcagacagtatataggaagtagtcccttgaccagcagcccaggggccgctgtgcccccagaggtgctcttggaggagggtgccaggggaagacggatgggcccttggtggaggctgaggaggacggtgaccgtggtcccttggcccagacgtccataccgtagtagtagtcccagcaggtggtagtactccacaatatgtcctcgcacagtatacacagccgtgtcctcggctctcagccgctgttcatttgcagatacagcgtgttcttggaattgctctctggagatggtgaatcggcccttcacggagtctgcatagtatttattacttccatcatacctaccatataagtgccagcccactccagcccttgcctggagcctggcggacccagtgcatgccataggtactgaaggtgaatccagacgctgcagcgagagtctcagggacctccccggcgcgaccacgcctcccccagactccaccagctgcacctgacactggacacctcttaaaagagcaacgagggaaaaccccagctcagccccaaactccatggtgagttcctctgtgttcagtgctgatcaccggaatggaaacaccgccgacttctagtgctgggctcctctcccagagctccccgcgactgagtgatactaaatcgagcaccggtcgtgtatatactgtctgatggcgcgagggaggcgatacgatc

SEQ ID NO: 791867 - DNA, 706 bp, Homo sapiens
  misc_feature: 39155.UNK.UNK.UNK.pb.heavy.1.raw 39155
ctatgcgccttgccagcccgctcagacagtatataggaagtagtccttgaccaggcagcccagggccgctgtgctctcggaggtgctcctggagcagggcgccaggggaagacgatggcccttggtggaggctgaggagacggtgaccagggttccccggcccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagcccccttccctggagcctggcggacccagttcatggcatagtcactgaagatgaatccagaggctgcacaggagagtctcagggacccccccgctgtaccaagcctcccccagactccaccagccgcacctcacagtggacaccttctaaaatagcaacaaggaaaacccagcgcagccccaactccatggtgagtcctctgtgttcagtgctgatcaccaagtggaaatgccttggaatccagggctaaggcacctctctgagagctcccaagagagatcgtgacgcagctaaatcgagcacggtcgtgtatatactgtctgatggcgcgaggaggcgatacg

SEQ ID NO: 791868 - DNA, 712 bp, Homo sapiens
  misc_feature: 39161.44.55.E11.1.pb.heavy.1.raw 39161
cgtatcgcctcctcggcgccatcagacagtatataccacgaccggtgctcgatttagcactcgcacgttgggttgggggggagaggaggcccagcactgggattccgaggtgtttccattcggtgatcagcactgaacacagaggactcaccatggagttttggctgagctggttctccttgttggaccttttaaaaggtgtccagtgtgaggtggcggctgatggagtctggaggaggcttagtccagcctggggggtcccagagactcttcctgtgcagcctctgggctcaccgtcagcagcaactacatgagttgggtccgccaggctccagggaaggggctggagtggggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgccctccaccaagggcccatcggtcttccccctggcaccctcctccaagagcacctctgggggcacagcggccctgggcctgcctggtcaaggactacttcctatatactgtctgagcggggctggcaaggcgcatag

SEQ ID NO: 791869 - DNA, 653 bp, Homo sapiens
  misc_feature: 39185.UNK.UNK.UNK.pb.heavy.1.raw 39185
ctatgcgccttgccaggccgctcagacagtatataggaagtagtctgaccaggcagcccagggcgctgtgccccagaggtgctcctgagcaggcgcaggggaagaccgatgggcccttggtggaagctgaggtgacaatgacagggttccctgccccagatctcaaaggctccatgcgagctgggtacggacctctcgcacagtagtagacggccgtgtcgtcggatttcaagaactcattgtcatggagactgtgtctgtggacttgtccgcggtaatcgtaattctgcccggaagtctcgtgcgtaggtgagtgagccaaaaagagggatgatccacccatccatcaagcctgtccagggcctggcgcacccagttgatgtataagtagtggaactggtagtacttccagaggccgtgcaggaaagggtcaccgaggacaaaggttgcggcattctagtccagactgcaccagttgcaccagggactggacacctgttgctgctgcaccacaaagagaacctccaggtccagtccatggtgatgagctgtgctccaggggcttcttagaggaggaaagtgtgtcagtagatctaaatcgagcaccggtccgtgcgtatatactgtctgatgcgcccgagggaggcgatacg

SEQ ID NO: 791870 - DNA, 658 bp, Homo sapiens
  misc_feature: 39186.UNK.UNK.UNK.pb.heavy.1.raw 39186
cgtatcgcctccctcgcgccatcagacagtatatacacgaccggtggctcgatttagtgctatagacttgggtttggggatgctttctgagagtcaaggacctcctgtgcaagaacatgaagcacctgtgttttttcctcctgctggtggcagctcccagatgggtcctgtccaggtgcagctgcaggagtcgggcccaggactggtgaggccttcgggaaccctgtctctcatctgcactgtctctggagtttccatcagtttctgatcattcttggggctggatccggcagcccccagggaggggaatggagtggattggtgacatccattatactggggcgacgtactactctccgtccctcaagagtcgtctcaccatttcgagggacacgtccatgaacgcgcttctccctgaaactgacccccgtgaccgccgcggacacggccgtttattctgtgcgaggcgagactggtcttcaatctatggggggccgtggcaccctggtcactggtctcctcagccttccaccaagggcccatcggtcttcccctggcgccctgctccaggagcacctctggggcacagcggccctgggctgcctggtcaaggactacttccctatatactgtctgagcgggctggcaaggcgcatag

SEQ ID NO: 791871 - DNA, 656 bp, Homo sapiens
  misc_feature: 39189.UNK.UNK.UNK.pb.heavy.1.raw 39189
cgtatcgcctccctcgcgccatcagacagttatatacacgaccgggtgctcgatttagtgctatagacttgggtttggggatgctttctgagagtcaagacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctgagtttccatcagttctgatccattctggggctggatccggcagcccccaggggagggaaatggagtggattggtgacatccattatactggggcgacgtaactactctccgtccctcaaggtcgtctcaccatttcgagggacacgtccatgaaccgcttctccctgaactacctccgtgaccgccgcggacacggccgtttattctgtgcgaggcgagactggtctttcaatctatggggccgtggcaccctggtcactgtctcctcagcttccaccaagggcccatcggtcttcccccctggcggccctgctccaggagcacctctgggggcacagcggccctgggctgcctggtcaaggactacttcctatatactgtctgagcgggctggcaaaggcgcatag

SEQ ID NO: 791872 - DNA, 651 bp, Homo sapiens
  misc_feature: 39214.44.12.B01.1.pb.heavy.1.raw 39214
ctatgcgcctgccagcccgctcagacagtatatagaagtagtccttgaccaggcagcccagggccgctgtgccccagaggtgctcttggaggagggtgccagggggaagaccgatggccttggtggaggctgaggagacggtgaccagggtccctggccccagtggtcaaaagtgttggtgacgaactgccctactctcgcacagtaatacacggcgggtccgcggcggtcacagagctcagcttcaggagaactggttcttggacgtgtctactgatatggtgactcgactctctgagggacgggttgtagtaggtgctcccactataatagatactcccaatccactccacgccccttccctggggctggcggatccagcccagtagtaactactactgctgatggagccaccagagacagtgcaggtgaggacaggtctccgaagcttcaccagtcctgggcccgactcctgcagctgcagctggacaggacccatctgggagccgccaccagcaggaggaagaaccacaggtgcttcatgttcttgcacaggaggtccatgactctcagaagcccccgcggaatctacactactaaatcgagcaccggtcgtgtatatactgtctgatggcgcgagggaggcgtacg

SEQ ID NO: 791873 - DNA, 616 bp, Homo sapiens
  misc_feature: 39234.44.23.C01.1.pb.heavy.1.raw 39234
cgtatcgcctccctcgcgccatcagacagtatatacacgaccggtgctcgatttagtacacgtgattagggattggggcagggtgaacacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgacgccgcggacacggccgtttatttctgtgcgaggcgagactggtctttcaatctatggggccgtggcaccctggtcactgtctcctcagcttccaccaagggcccatcggtcttcccctggcgcctgctccaggagcacctctgggggcacagcggccctgggctgcctggtcaaggactacttcctatatacggtctgagcgggctggcaaggcgcatag

SEQ ID NO: 791874 - DNA, 699 bp, Homo sapiens
  misc_feature: 39241.44.36.D03.1.pb.heavy.1.raw 39241
ctatgcgccttgccagcccgctcagacagtatataggaagtagtccttgaccaggcagcccaggccgctgtgctctcggaggtgctcctggagcagggcgccaggggaagaccgatgggcccttggtgaggctgaggagacggtgaccagggttccctggccccagtggacagttcctgatataaacacaacacaataatacatgcccgtgtcctcggttttcaggttagtcattcgcagaatcaatgagttcttgaagtcatctcttgagaggtgaatctggctttcacagacgcggcgtactctgtgataaagctggcaactttgtttttactgcgccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctcgctctcagagctccccaagagagatcgtgacgcagctaaatcgagcaccggtcgtgtatatactgtctgatggcggcgagggaggcgatacg

SEQ ID NO: 791875 - DNA, 708 bp, Homo sapiens
  misc_feature: 39267.44.62.F07.1.pb.heavy.1.raw 39267
ctatgcgccttgccagcccgctcagacagtatataggaagtagtccttgaccaggcagcccagggccgctgtgctctcggaggtgctcctggagcagggcgccagggggaagaccgatgggccctggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcgacccaggtcatgccataggcactaaaggtgaatccagaggccgcacaggagaggtcagggacctcccaggccgaatcaggccccccccagactccaacaactgcacttcacacacgacaccctttaaaaaagccacaagaaaaaggcagctcagcccaaactccatggagacttctctctgttcggttcctggtcaccaaatgaagacacctgaaaatcccagggctggctcctctctcagagctcccctttccctttatgcgactactaaatcgagcaccggtcgtgtatatactgtctgatggcgcgagggagcgatacg

SEQ ID NO: 791876 - DNA, 713 bp, Homo sapiens
  misc_feature: 39342.44.62.F07.1.pb.heavy.1.raw 39342
cgtatcgcctccctcgcgccatcagacagtatatacacgaccggtgctcgatttagtagtcgcataaagggaaaggggagctctgagagaggagcccagccctgggatttcaggtgtcttcatttggtgaccaggaccgaacagagagaagtctccatggagtttgggctgagctgcctttttcttgtggctttttaaagggtgtcgtgtgtgaagtgcagttgttggagtctggggggggcctgattcggcctgggaggtccctgacccctctcctgtgcggcctctggattcacctttagtggcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaacctgagacccgaggacacaggcgtctattactgtttgaaagccaggaccacggtgaccccccatgacacctttagtacttggggccgggggacagtggtgacccgtctcttcagcctccaccaagggcccatcggtcttccccctggcgccctgctccaggagcacctccgagagcacagcggccctgggctgcctggtcaagggactacttcctatatactgtctgagcgggctggcaaggcgcatag

SEQ ID NO: 791877 - DNA, 703 bp, Homo sapiens
  misc_feature: 39352.44.36.D03.1.pb.heavy.1.raw 39352
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtcccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 791878 - DNA, 704 bp, Homo sapiens
  misc_feature: 39355.UNK.UNK.UNK.pb.heavy.1.raw 39355
cgtatcgcctccctcgcgccatcagacagtatatacacgacggtgctcgatttagcagacgtctgaacacacaaagggcgctggagaggagccccagccgtgagattcccaggagtttccacttggtgatcagcactgagcacagaccaccaaccatggagtttgggctaatcttgattttccttgtagtttttttagaaggtgtcagtgcgagggcgactggcggagtcgggggggggcttggcacagccagggcggtctctgagactctcctgtgtagtctcaggatcagtcttagtgattatcacttggcctgggtcgtcaggctccagggaaggggcttgagtggatcactttcgtcagaatgaaacgttatggtggaagtaaagagtacgccgcgtctgtgaagggaagatcaccgtctcaaggatgactccaacagtgttggccatttacaaatgagcaacctgagacccgacgacacaggcgtctattactgcgccaggcgatcctgggacgtcgatgcatttgatattggggccaggggacaatggtcaccgtctcttcagcttccaccaagggcccatcggtcttccccctggcgcgccctgctccaggagcacctctggggcacagcggccctgggctgcctggtcaaggactacttcctatatactgtctgagcgggctggcaaggcgcatag

SEQ ID NO: 791879 - DNA, 699 bp, Homo sapiens
  misc_feature: 39365.44.74.G08.1.pb.heavy.1.raw 39365
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgttctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactactgtcctgagcgggctggcaaggcgcatag

SEQ ID NO: 791880 - DNA, 656 bp, Homo sapiens
  misc_feature: 39366.44.23.C01.1.pb.heavy.1.raw 39366
cgtattcgcctccctcgcgccatcagacagtatatatacacgaccggtgctcgatttagtacacgtgattagggattgggggctttctgagagtcaaggacctcctgtgcaagaacatgaagcacctgtggtttttcctcctgcttggtggcagctcccagatgggtcctgtccaggtgcagctgcaggagtcgggcccccaggactggtgaggcctcggaaccctgtctctcatctgcactgtctctggagtttccatcagttctgatcattcttggggctggatccggcagcccccagggaggggaatgagtggattggtgacatccattatactggggcgacgtactactctcccgtccctcaagagtcgtctcaccatttcgagggacacgtccatgaaccgcttctccctgaactgacctccgtgaccgcgcggacacggccgtttatttctgtgcgaggcgagactggtctttcaatctatggggccgtggcaccctggtcaacttgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791881 - DNA, 654 bp, Homo sapiens
  misc_feature: 39389.UNK.UNK.UNK.pb.heavy.1.raw 39389
tataggaagtagtccttgaccaggcagcccagggccgctgtgctctcggaggtgctcctggagccagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagttttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaaacccagctcagcccaaactccatggtgagtcctctgtgttcagtgctgatcaccgaatggaaacaccgccgacttctagtgctgggctcctctcccagcccctttcccttactgactcactaaatcgagcaccgtcgtgtatatactgtctgatgcgccgagggaggcgatacg

SEQ ID NO: 791882 - DNA, 702 bp, Homo sapiens
  misc_feature: 39403.44.67.G01.1.pb.heavy.1.raw 39403
ctatgcgccttgccagcccgctcagccagtatataggaagtgtccttgaccaggcagcccaggccgctgtgcccccagaggtgctcttggaggagggtgccagggggaagacgatgggccctggtggaggcggaggcgacggtgaccagggttccctggccccagaagtcaaacgaataataacactccgagcgccgacttgtctcgcacagtaatagacggccgtgtcgtcgcctctcaggttgttctttgaagataaaccgtgttcctggaaattgtccctggagatggtgaatcggcccttcacggagtctgcgtagtatgtgaaatcaccagtataaatgactgagacccactccagccccttccctggagcctggcggacccaactcatgtaggttgtgctgacggtgagccagaggctgcacaggagagtctctgggacccccccaggctggactaagcctcctccagactccatcagccgcacctcacactggacaccttttaaaagtccaacaaggagaacccagctcagccaaactccaatggtgagtcctctgtgtcagtgctgatcaccgaatggaaacacctcggaatcccagtgctgggctcctctccccccccaaacccaatatgtatactctaaatcgagcaccggtcgtgtatatactgtctgatggcgcgagggggaggcgatac

SEQ ID NO: 791883 - DNA, 732 bp, Homo sapiens
  misc_feature: 39404.44.85.H08.1.pb.heavy.1.raw 39404
cgtatcgcctccctcgcgccatcagacagtatatacacgaccggtgctcgatttagtatcactcagtcggcgggagctctgggagaggagcccagcactagaagtcggcggtgtttccattcggtgatcagcacttgaacaccagaggactcaccatggagtttgggctgagctgggtgtttcctcgttgctcttttagagggtgtccagtgtcaggtgcagctggtggagtctggggggaggcgtggtccagccctgggaggtccctgagactctcctgtgcagcgtctggattcaccttcagtacctatggcatgcactgggtccgccaggctccaggcaaggggctggagtggtggcacttatatggtatgatggaagtaataaatactatgcagactccgtgaagggccgattcaccatctccagagacaattccaagaacacgctgtatctgcaatgaacagcctgagagcgaggacacggctgtgtatactgtgcgaggacatattgtagtactaccacctgctggactactactacggtatggacgtctggggccaagggaccacggtcacccgtcctcctcagcctccaccaagggccccatcggtcttccccctggccacgctcctccaagagcacctctgggggccacagcggccctgggctgcgccctggtcaaggactacgttcctatatactgtctgagcgggctggcaaggcgcatag

SEQ ID NO: 791884 - DNA, 646 bp, Homo sapiens
  misc_feature: 39407.44.86.H09.1.pb.heavy.1.raw 39407
cgtatcgcctcctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttgggctggatccgcagcccccagggagggaatgagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcgtctccccctggcgccctgctcaggagcacctctgggggcacagcggccctgggctgcctggtcaaggactacttcctatatactgtctgagcgggctggcaaggcgcatag

SEQ ID NO: 791885 - DNA, 726 bp, Homo sapiens
  misc_feature: 39414.UNK.UNK.UNK.pb.heavy.1.raw 39414
ccagcccgctcagacagtatataggaagtagtccttgaccagcgcagcccagggccgctgtgcccccagaggtgctcttggaggagggtgccagggggaagaccgatgggcccttggtggaggctgaggagacggtgaccgtggtcccttggccccagacgtccataccgtcagtagtagtcccagcaggtggtagtactacaatatgtcctcgcacagtaatacacagccgtgtcctcggctctcaggctgttcatttgcagatacagcgtgttcttggaattgtctctggagatggtgaatcggccttcacggagtctgcaatagtatttattacttccatccatgaccatataagtgccacccactccagccccttgcctggagcctggccggacccagtgcatggccataggtactgaaggtgaatccagacgctgcacaggagagtctcagggacctcccaggctggacacgctccccccagactccaccagctgccacctgacactggacacctcttaaaagagcaacgaggaaaacccagctcaagcccaaactccatgggtgagtcctctgtgttcagtgctgatcaccgaatggaaacaccggccgaacttctagtgctgggctcctctcccagagctccccgcgactggacgtgatactaaatcgagcaccgtcgtgtatgatactgtctgatggcgggcgaggggaggcgatacg

SEQ ID NO: 791886 - DNA, 718 bp, Homo sapiens
  misc_feature: 39429.44.36.D03.1.pb.heavy.1.raw 39429
cgtatcgcctccctcgcgccatcagacagtatatacacgaccggtgctcgatttagctgcgtcacgatctctcttgggagctctcagagaggtgccttagccctggattccaaggcattttccacttggtgatcagcactgaacacagaggactcaccatggagttggggctgcgctgggttttccttgttgctattttagaaggtgtccactgtgaggtgcggctggtggagtctggggaggcttggtacagcgggggggttccctgagactctcctgtgcagcctctggattcatcttcagtgactatgccatgaactgggtccgccagggctccagggaaggggctggagtgggtttcatatgttaatattgctggagataccacctactacgcagactctgtgaagggccgattcaccaattccagggacaatgccaagaactcactggtatctggaaatgaacagcctgagagacgaggacacggctgtctacttctgttcgagagatcggggccacttggtcagtggctggttttgactactgggggccggggaaccctggtcaccgtcttcctcagcctccaccaagggcccatcggtcttccccctggcgccctgctccaggagcacctccgagagcacagcggccctgggctgcctggtcaaggactacttcctatatacctgtctgagcgggctggcaaggcgcatag

SEQ ID NO: 791887 - DNA, 664 bp, Homo sapiens
  misc_feature: 39468.44.45.E01.1.pb.heavy.1.raw 39468
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactccaccatggagtttgggctgagctgggtttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcgccctgggctgcctggtcaaggactacttcctatatactgtctgagcg

SEQ ID NO: 791888 - DNA, 714 bp, Homo sapiens
  misc_feature: 39471.UNK.UNK.UNK.pb.heavy.1.raw 39471
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagaacggtcaccactgtcccccggccccaagtactaaaggtgtcatggggggtcaccgtgggtcctgctttcaaaacagtaatagacgcctgtgtcctcgggtctcaggtttttcatttggagaaacaatttgtcctgcgaattgtccctggaaatggtgaagcggcccttcacggagtctccgtagaaagtgacacccaccagcttcgatacttgagacccactccagtcccctccctggagcccggcggaacccaggtcatgccataggcactaaaggtgaatccagaggccgcacaggagaggggtcagggacctcccaggccgaatcaggcccccccagactccaacaactgcacttcacacacgacacctttaaaaaagccacaagaaaaaggcagctcagcccaaactccatggagacttctctctgttcgtcctggtcaccaaatgaagacacctgaaaatcccagggctggctctcctctctcagagctcccctttccctttatgcgactactaaatcgagcaccgtcgtgtatatactgtctgatggcgcgagggaggcgatacg

SEQ ID NO: 791889 - DNA, 707 bp, Homo sapiens
  misc_feature: 39479.44.36.D03.1.pb.heavy.1.raw 39479
ctatgcgcctgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttcctggccccagtggacagttcctgatataaacacaacacaataatacatgcccgtgtcctcggtttttcaggttagtcattcgcagaatcaatgagttcttgaagtcatctcttgagagggtgaatctggctttcacagacgcggcgtactctgtgataaagctggcaactttgtttttactgcggccaagccactccagcccctttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagccccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgaatggcgcgagggaggcgatacg

SEQ ID NO: 791890 - DNA, 676 bp, Homo sapiens
  misc_feature: 39486.44.12.B01.1.pb.heavy.1.raw 39486
cgtatcgcctccctcgcgccatcagacagtatatacacgaccggtgctcgatttagtagtgtagatccgcgggggcctttctgagagtcatggacctcctggtgcaagaacatgaagcacctgtggttcttcctcctgctggtggcggctcccagatgggtcctgtcccagctgcagctgcaggagtcgggcccaggactggtgaagccttcggagaccctgtccctcacctgccactgtctctggtgctccatccagcagtagtagttactactgggggctggatccgccagcccccagggaaggggctggagtggattgggcagtatcctatttatagtggagcacctactacaacccgtcccctcaagagtcgagtcaccatatcagtagacacgtccaagaaccagttctccctgaagctgagctctgtgaccgccgcgcggacacggccgtgtattactgttgcgagagtagggcagttcgtcaccaactactttgaccactgggggccagggaaccctggtcaccgtctcctcagcctccaccaagggcccatcggtcttccccctggcaccctcctccaagagcaccttctgggggcacagcgggccctggctgcctggtcaaggactacttctatatactgtctggagcgggctggcaaggcgcatag

SEQ ID NO: 791891 - DNA, 718 bp, Homo sapiens
  misc_feature: 39520.44.86.H09.1.pb.heavy.1.raw 39520
cgtatcgcctccctcgcgccatcagacagtatatacacgaccggtgctcgatttagtgctatagacttgggttgggagctctggagaggagcccagcaccagaagtcggcggtgtttccagtcggtgatcagcaccgaacacagagactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatgtatggacgccggggccaaggaccacggtcgccgtctcctcagcctcaccaagggcccatcggtcttcccctggcaccctcctccaagagcacctctggggcacagcggccctggctgcctggtcaaggactacttcctatatactgtctgagcgggctggcaaggcgcatag

SEQ ID NO: 791892 - DNA, 609 bp, Homo sapiens
  misc_feature: 39534.44.38.D05.1.pb.heavy.1.raw 39534
ctatgcgccttgccagcccgctcagacagtatataggaagtagtccttgaccaggcagcccagggccgctgtgccccagagtgctcctggagcagggcgccaggggaagaccgatgggcccttggtgaagctgaggagacggtgaccgtggtcccttggcccagacgtccataccgtagtagtagtatgcaactccccgaactccgcacggctcttgcacagtaatacacagccgtgtcctcggctctcagactgttcatttgcagatacagcgtgttcttggcgttgtctctgggatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcaggacccgccaggctgaactaagcctccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 791893 - DNA, 689 bp, Homo sapiens
  misc_feature: 39535.UNK.UNK.UNK.pb.heavy.1.raw 39535
cgtatcgcctccctcgcgccatcagacagtatatacacgacggtgctcgatttagctgcgtcacgatctctcttggggagagcggagccccagccccagaattccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggacttggtccgccaggctccaggaaggggctggagtgctggccgcagtaaaaacaaagttgccagctttatcacagagtacgccgcgtctgtgaaagccagattcacctctcaagagatgacttcaagaactcattgattctgcgaatgactaacctgaaaaccgaggacacgggcatgtattattgtgttgtgtttatatcaggaactgtcactggggccagggaaccctggtcaccgtctcctcagcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 791894 - DNA, 619 bp, Homo sapiens
  misc_feature: 39543.44.19.B08.1.pb.heavy.1.raw 39543
cgtatcgcctcccccgcgccatcagacagtatatacacgaccggtgctcgatttagtgagtcagtaaggggactcctgtgccccccatggcacacttgctcccgctcctgctgctgaccatccctcatgggcctgtccagatcaccgtgaaagagtctggcccacttgggaaacccacaccagaccctcacgctgacctgcaccgtctcaggcttctcactcgtcactccggagagggcgttgctggtgcggcagccccccggaggccctggatgatcgcactcacttattggatgacgatatacgatatagtccttctctgacgaccagactcacggctcacgaaggacacgtccaaaaaaccaggtggtccttacattgaccaacgtggaccctgtggcacaggcacatatttctgtgcccacttatgaccacaatgaccacggctcttcgaaccctggggccagggaaccaggtcaccgtctatcagcctccccaagggcccatcggtcttccctggcgccctgctccagggcacctccgagagcacgcggccctgggctgcctggtcaaggactacttcctatatactgtctgagcgggctggcaaggcgcatag

SEQ ID NO: 791895 - DNA, 612 bp, Homo sapiens
  misc_feature: 39568.UNK.UNK.UNK.pb.heavy.1.raw 39568
gaaggctgggcaggctatgcaccctggtccaggtcaaaagctgcggaacccgctagcggccatcttggccacctaggggtcccgcaggattcatattgtcgtctagcatgcacaatgctgcaaacccagcttgcaaatgccacagcaagcggccaatcttttacgccaacgttgaattgtttattacctgtgactggctatggcttgcaacgccactcgtaaaactagtactttgcggttaggggaaagtagacaaaccattactccactcccggaagttcaactcattcaacacgaataaaagtaaactcaacaccccaagcaggcctatgtggggggtggatagggggtggattctatttcctaatcccatcccctaggatctcaattaagtactagcgagttaaatgtctgtagcgatcccgtcagtctatcgcgcgcatcaaagacctggttggttgagcgtgcagtagatcatcgataagctgcgagttaggtcatccagaccgcgcatctggcgcctaaacgttcagtggtagctaaggcgtcaccttcgactgtctaaaggcaatatgtcgtccttagctccaagtccctagcaagcgtgtcggg

SEQ ID NO: 791896 - DNA, 545 bp, Homo sapiens
  misc_feature: 39646.44.38.D05.1.pb.heavy.1.raw 39646
ctatgcgccttgccagcccgctcagacagtatataggaagtagtccttgaccaggcagcccaggccgctgtgccccagaggtgcttcctggagcagggcgccagggggaagaccgatgggcccttggtggaagctgaggagacggtgaccgtggtcccttggccccagacgtccataccgagtagtaagtatgcaactccccgaactcccgcaccgggctcttgcacagtaatacacagccgtgtcctcggctctcagactgttccatttgcagatacagcgtgttcttggcgttgtctctggagatggtgaatcggcccttcacggagtccgcgtagctgtgctactccatcactattaatacgtgagacccacaccagccccttccctggagcttggcggacccaggtgcatccagtagctactgaaggtgaatccagaggctgcacaggagagtctcagggaccccccaaacccaactatcagatactaaatcgagcaccggtcgtgtatatactgtctgatggcgcgagggaggcgatacg

SEQ ID NO: 791897 - DNA, 666 bp, Homo sapiens
  misc_feature: 39649.UNK.UNK.UNK.pb.heavy.1.raw 39649
ctatgcgccttgccagcccgctcagacagtatataggaagtagtccttgaccaggcagcccagggccgctgtgcccccagaggtgctcctggagcagggcgccaggggggaagaccgatggggcctttgcgtggaagcctgaggagacagtgcgcagccggtgccacggcccatagattgaaagaccagtctcgcctcgcacagaaataaacggccgtgtcgcggcggtcacggaggtcagtttcagggagaagcggttcatcggacgtgtccctcgaaaatggtgagacgactcttgagggacggagagtagtacggtcgccccagtataatggatgtcaccaatccactccattccctccctgggggctgccggatccagccccaagaatgatcagaactgatggaaactccagagacagtgcagatgagagacagggttcccgaaggcctcaccagtcctggcccgactcctgccagctgcacctgggacaggacccatctgggagctgcccaccagcaggaggaaaaaccacaggtgcttcatgttcttgcacaggagggctccttgactctcagaaaagcccccaatccctaatcacgtgtactaaatcggcgagccccggtcgtgtatatactgtctgatggcgcgagggaggcgatacg

SEQ ID NO: 791898 - DNA, 575 bp, Homo sapiens
  misc_feature: 39664.44.78.H01.1.pb.heavy.1.raw 39664
cgtatcgcctccctcgcgccatcagacagtatatacacgaccggtgctcgatttagtgtgagtagttttgggtttgggtgccgaagtttgctggaggtcacggtcaccacgctgctgaggtgaagaagcctgggcctcagtgacagtctcctgcacggcttctggatacacgttcatcaattatgatattaaactgggtgcgacaggccgctggacaagggctggagtggatggaatggatgaagccctatagtggcaacacgggctttgcccagaagttccaaggcaagagttagtatgaccaggagcacctccccaggtacaagtctacatggaactgagcagcctgagatctgaggacacggccgtgtatttctgtgcgagagccaccagcacctggcttgacttgtgggccaggaacctggtcaccgtctcctcagcctccaccaagggcccatcggtcttccccctggccgccctgctccaggagcacctccgagagcacagcggccctgggctgcctggtcaaggactacttcctatatactgtctgagcgggctggcaaggcgcatag

SEQ ID NO: 791899 - DNA, 710 bp, Homo sapiens
  misc_feature: 39676.UNK.UNK.UNK.pb.heavy.1.raw 39676
ctatgcgccttgccagcccgctcagacagtatataggaagtagtcttgaccaggcagcccagggccgctgtgctctcggaggtgctcctggagcagggcgccagggggaagacgatgggcccttggtggaggctgaggagacggtgaccagggttccccggcccagtagtcaaaacagccactgaccaagtggcccgatctctcgaacagaagtagacaggccgtgtcctcgtctctcaggctgttcatttcagatacagtgagttcttggcattgtccctggaattggtgaatcggcccttcacagagtctgcgtagtaggtggtatctccagcaatattaacatatgaaacccactccagcccccttccctggagcctggcggacccagttcatggcatagtcactgagatgaatccagaggctgcacaggagagtctcagggacccccccgctgtaccaagcctcccccagactccaccagccgcacccacagtggacaccttctaaaatagcaacaaggaaaacccagcgcagccccaactccatggtgagtcctctgtgttcagtgctgatcaccaagtggaatgccttggaatccagggctaaggcaacctctctgagagctcccaagagaagatcgtgacgcagctaaatcgagccacccggtcgtgtatatactgtctgatggccgcgagggaggcgatacg

SEQ ID NO: 791900 - DNA, 550 bp, Homo sapiens
  misc_feature: 39685.44.43.D10.1.pb.heavy.1.raw 39685
ctatgcgccttgccagccgctcagacagtatataggaagtagtccttgaccaggcagcccagggccgctgtgcccccagaggtgctcctggagcagggcgccagggggaagaccgatgggcccttggtggaagctgaggagacggtgaccagggttccctggcccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttggcaggagaccttcactgaggccccaggcttcttcacctcagccccttactgctagtctaaatcgagcaccggtcgtgtatatactgtcgatggcgcgagggaggcgatacg

SEQ ID NO: 791901 - DNA, 691 bp, Homo sapiens
  misc_feature: 39721.44.73.G07.1.pb.heavy.1.raw 39721
cgtatcgcctccctcgcgccatcagacagtatatacacgaccggtgctcgatttagctctacgctcagggggggagacgagcccagcactggaagtccgccggtgtttccattcggtgatcatcactgaacacagaggactcaccatggactttgggctgagatggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtcccgcttgactactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 791902 - DNA, 603 bp, Homo sapiens
  misc_feature: 39724.UNK.UNK.UNK.pb.heavy.1.raw 39724
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccggaagtggagtaatgggtttgtcacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcggacccctagtggccaagatggccgctagcgggttccgcagcttttgacctggaccagggtgcatagcctgcccagccttc

SEQ ID NO: 791903 - DNA, 708 bp, Homo sapiens
  misc_feature: 39759.UNK.UNK.UNK.pb.heavy.1.raw 39759
ctatgcgccttgccagcccgctcagacagtatataggaagtagtccttgaccaggcagcccaggccgctgtgctctcggaggtgctcctggagcagggcgccaggggaagaccgatgggcccttggtggaggctgaggagacggtgaccagggttccctggccccagtggacagttcctgatataaacacaacacaataatacatgccccgtggtcctcggttttcaggttagtcattcgcagaatcaatgagttcttgaagtcatctcttgagaggtgaatctggctttccacagacgcggcggtactctgtgataaagctggcaactttgtttttactgcggccaagccactccagcccctttcctggagcctggcggacccagtccatatagtggtcactgatggtgaatccagaggcgacacaggagagtctcagggaccctccaggctggaccaagtctcccccggactccaccaactgcacttcactctggacaccttgtaaaataacaaacaaggaaaaccagctcagcccgaactccatggtgagtcctctgtggttcagtgctgatcaccaatgaaaacacctgggaattctggggctggggctccgctcttcagagctccccaagagagatcgtgacgacagctaaatcgagcaccggtcgtgtatatactgtctgatggcgcgagggaggcgatacg

SEQ ID NO: 791904 - DNA, 708 bp, Homo sapiens
  misc_feature: 39794.44.36.D03.1.pb.heavy.1.raw 39794
cgtatcgcctccctcgcgccatcagacagtatatacacgaccggtgctcgatttagctgcgtcacgatctctcttggggagctctgagagcggagccccagccccagaattcccaggtgttttcatttggtgaatcagcactgaacacagaggactcaccatggagttcggggctgagctgggttttccttgttgttattttacaaggtgtccagagtgaagtgcagttggtggagtccgggggagacttgtccagcctggagggtccctgagactctcctgtgtcgcctctggattcaccatcagtgaccactatatggactgggtccgccaggctccagggaaggggctggagtggcttggccgcagtaaaaaacaaagttgccagctttatcacagagttacgccgcgtctgtgaaagccagattcaccctctcaagagatgacttcaagaactcattgattctgcgaatgactaacctgaaaaccgaggacacggcatgtattattgtgttgtgtttatatcaggaactgtccactgggggcccagggaaccctggtcaccgtctcctcagcctccaccaagggcccatcggtcttccccctggcgccctgctccaggagcacctccgagagcacagcggccctgggctgcctggtcaaggactactcctatatactgtctgagcgggctggcaaggcgcatag

SEQ ID NO: 791905 - DNA, 711 bp, Homo sapiens
  misc_feature: 39803.44.56.F01.1.pb.heavy.1.raw 39803
ctatgcgccttgccagccgctcagacagtatataggaagtagtccttgaccaggcagcccagggccgctgtgcccccagaggtgctcctggagcaggcgccagggggaagaccgatgggcccttggtggaagctgaagagacggtgaccattgtcccctggccccaatattcaaatgcatcgacgtccaggatcgcctggcgccagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccgactccgccagtcgcccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 791906 - DNA, 674 bp, Homo sapiens
  misc_feature: 39818.UNK.UNK.UNK.pb.heavy.1.raw 39818
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgctggagcctggcggaccagtgcatggcagagtcactgaactgagtccggacgcaacacaggagagtctcaggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttccttactgactcactaatcgagcaccgtcgtgtatatactgtctgatggcgcgagggaggcgatacg

SEQ ID NO: 791907 - DNA, 638 bp, Homo sapiens
  misc_feature: 39824.UNK.UNK.UNK.pb.heavy.1.raw 39824
ctatcgctcctcgcgccatcagacagtatatacacgaccggtgctcgatcttagctgcgcaccgatctccttggggagctctgaggagacgagccagcccagaattcccaggtgttttcatttgtgatcagcactgaacacagaggactcacatgcggctggctggttttccggttagtcattgccagagtcaatgagttcttggagtcatctctgagaggtccagctgggggtcccgagactcgcccctgtgtcgcctctggattcaccatcagtgcacttgactggtccgccaggctccaggaagggctggagtggctggccgcagtaaacaagtggccagctttatcacagagtacgccgcgtctgtgaaagccagatcaccctctcagagatgacttcaagaactcattgattctgcgaatgactaacctgaaaccgaggacacggcatgattattgtggtgttaatcaggaactgtccactggggcaggaaccctggtcacgtctcctcagcctcacaagggcccatcggtctccctggcgccctggctccagggcacctccgagagcacagcggccctgctaacctggcaggctcttcctatatactgtctggcgggcggcaggcgcatacg

SEQ ID NO: 791908 - DNA, 458 bp, Homo sapiens
  misc_feature: 39852.44.36.D03.1.pb.heavy.1.raw 39852
cgtatcgcctccctcgcgccatcagacagtatatacacgaccggtgctcgatttagctgcgtcacgatctctcttggggctggatccggcagcccccagggagggggaatggagtggattggtgacatccattataactggggcgacgtactactctccgtccctcaagagtcgtctcaccatttcgagggacacgtccatgaaccgcttctccctgaaactgacctccgtgaccgcgccgcggacacggccgtttatttctgtgcgaggcgagactggtctttcaatctatggggccgtggcaccctggtcactgtcctcctcagcttccaccaagggccatcggtcttcccctggcgcctgctccaggagcacctctggggggcacagcggccctgggcgcctggtcaaggactacttcctatatactgtctgagcgggctggcaaaggcgcatag

SEQ ID NO: 791909 - DNA, 675 bp, Homo sapiens
  misc_feature: 39869.44.35.D02.1.pb.heavy.1.raw 39869
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctccagatgggtcgtgtccgaggtgcagctgcaggagtcgggcccaggacgggtgaagccttcggagaccctgtccctcacctgcaatgtctctggtggttacatcagtagttattattggagttggctacggcagtccgccgggaagggactggagtggattgggcgcatctataacagtggcagcaccaactacaaccccgccctcaagagtcgagtcaccatgtcactagacaggtccaagaaccagttctcctgaaattgacttctgtgaccgccgcggacacggccgtatattattgtgcgagagattcctatcgatacagtagagacggggggcgaactggctcgacccctggggccagggaaccctggtcaccgtctcctcagcctccaccaagggcccatcggtcttccccctggcaccctcctccaagagcactctgggggcacagcggccctgggctgcctggtcaaggactacttcctatatactgtctgagcgggctggcaaggcgcatag

SEQ ID NO: 791910 - DNA, 567 bp, Homo sapiens
  misc_feature: 39886.44.78.H01.1.pb.heavy.1.raw 39886
cgtatcgcctccctcgcgccatcgacagtatatacacgaccggtgctcgatttagtgtgagtagtttgggtttggggaagaggaagactgacggtccactcccaggtacagctggtgcagtctggggctgaggtgaagaagcctgggcctcagtgacagtctcctgcacggcttctggatacacgttcatcaattatgatattaactggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggctgacttgtggggccagggaaccctggtcaccgtctcctcagcctccaccaaggcccatcggtcttccccctggcgccctgctccaggagcacctccgagagcacagcggccctggctgcctggtcaaggactacttcctatatactgtctgagcggg

SEQ ID NO: 791911 - DNA, 664 bp, Homo sapiens
  misc_feature: 39918.44.21.B10.1.pb.heavy.1.raw 39918
ctatgcgccttgccagcccgctcagacagtatataggaagtagtccttgaccaggcagcccaggccgctgtgcccccagaggtgctcttggaggagggtgccagggggaagaccgatgggcccttggtggaggctgaggagacggtgaccggggtccctttgcccagacgtccatgtagtagtaatacttgtattgttgtaacttctgcgaccctctggcacagtaataaagggccgtgtcgtccactcgcaggctcttcatctgcagaaacaccgtattcttgaattgtccctggagacgatgagcggccttcacggagtctgcgacatttgtggcactaccaccagtaatggatgagacccactccagcccttccctgggcctgacggacccagatcatggcataggtattaaaggcgaatccagaggctgcacaggagagtgtcagggaccccccggctgtaccaagcctcccccgactccaacagctgcacttcacactggacaccttttaaaacagccacaagaaaaagccagctcagcccaaactccatggtgagttctctctgttcagtccccagggctgggctcctctctctgcgacgacactaaatcgagcaccggtcgtgtatatactgtctgatggcgcgaggaggcgatacg

SEQ ID NO: 791912 - DNA, 611 bp, Homo sapiens
  misc_feature: 39949.UNK.UNK.UNK.pb.heavy.1.raw 39949
cccgacacgcttgctaggacttggagctaaggacgacatattgccttttagaaggacgtcaaggtgacgccttagctaccactgaacgtttaggcgcagatgcggtctaggatgaaccctaactcgcagctatatcgatgatctactgcacgctcaaccaaccagggtcttgatgcgcgcgataggactgacggggatcgctacagacatttaactcgctagactaattgagatctaggggatggataggaaatagaatccacccctatcacccccccacatagcctgcttggggtgtcgttgagtttactttttattcgtgttggaatgagttgaacttccgggaagtgtagtaatggtttgtctacctcccctaaccgcaaagtactagtttacgagtggcgttgcaagccatagccagtcacagtaataaacaattcaacgtggtcggtaaagattggccgcttgctgtcgggcattgcaagctgggttctgcagcattgtgcattgcagacgacaatatgaatctgcgggacccctagtggccaagatggccgctagcgggttccgcagcttttgacctggaccagggtgcatagcctgccagcctt

SEQ ID NO: 791913 - DNA, 576 bp, Homo sapiens
  misc_feature: 39952.UNK.UNK.UNK.pb.heavy.1.raw 39952
cgtatcgcctcctcgcgccatcagacagtatatacacgaccgggctcgatttagtgtgagtagttgggtttggggggaagaggaagactgacggtcccactcccaggtacagctggtgcagtctggggctgaggtgaagaagcctggggcctcagtgacagtctcctgcacggcttctggatacacgtcatcattatgatattaactgggtgcgacaggccgctggacaaggctggagtggatgggatggatgaagcctatagtggcacacgggctttgccagaattccaaggcagagttagtatgaccaggagcacctcccaggtacagtctacatggaactgagcagcctgagatctgaggacacggccgtgtatttctgtgcgagagccaccagcacctggcttgacttgtggggccaggaccctggtcaccgtctcctcagcctccaccaagggcccatcgtcttccccctggcgccctgctccaggagcacctccgagagcacagcggccctgggctgcctggtcaaggactacttcctatatactgtctgagcgggctgcaggcgcatag

SEQ ID NO: 791914 - DNA, 714 bp, Homo sapiens
  misc_feature: 39998.UNK.UNK.UNK.pb.heavy.1.raw 39998
cgtatcgcctccctccgcgccatcagacagtatatacacgaccggtgccgatttagcagacgtctgaacacacaaaggggagctcttgggagaggagccccagccgtgagattcccaggagtttccacttggtgatcagcactgagccacagaccaccaaccatggagtttgggctaatcttgattttcctgtagttttttttagaaggtgtcgcagtgcgaggggcgactggcggagtcgggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgcgcgtctgtgaagggaagattcaccgtctcaaagggatgactccaacagtgttggccatttacaaatgagcaacctgagacccgacgacacaggcgtctatttactgcgccaggcgatcctgggacgtcgatgcatttgatatttggggccaggggacaatggtcaccgtctcttcagcttccaccaagggcccatcggtcttccctggcgccctgctccaggagcacctctgggggcacagcggccctgggctgcctggtcaaggactacttcctatatactgtctgagcggctggcaaggcgcatag

SEQ ID NO: 791915 - DNA, 688 bp, Homo sapiens
  misc_feature: 40001.UNK.UNK.UNK.pb.heavy.1.raw 40001
ctatgcgccttgccagcccgctcagacagtatataggaagtagtccttgaccaggcagcccaggccgctgtgcccccagaggtgctcttggaggagggtggccagggggaagaccgatgggcccttggtggaggctgaggagacggtgaccagggttccctggccccaggggtcgagccagtttcgcccccccgtctctactgtatcgatagaatctctcgcacaataatatacgccgtgtccgcggcggtcacagaagtcaatttcagggagaactggttcttggacctgtctagtgacatggtgactcgactctgagggcggggttgtagttggtgctgccactgtttatagatgcggccaatccactccagtcccttcccggcggactgccgcagcccaactccaataataaactactgatgtaaccaccagagacattgcaggtgagggacaggggtcctcgaaggccttcacccgtcctgggcccggactctcctgcagctgcaccctcggacacgacccatctgggaggtgccaccaggaggaggaaagaaccacaggtgtttcatgttcttgtgcaggaggcgccatgagtctcagaagtatccccaaacccaactatcgtgtgctaaatcgcagcaccggtcgtgtatatactgtctgatggcgcgagggaggcgatacg

SEQ ID NO: 791916 - DNA, 687 bp, Homo sapiens
  misc_feature: 40005.UNK.UNK.UNK.pb.heavy.1.raw 40005
cgtatcgcctccctcgcgccatcagacagtatataccacgaccgtgctcgattttgatcacataacaaccacactcctcctctaaagaagcccctgggagcacagctcatcacatggactggacctggcggttcctctttgtggtggcagcagctacaggtgtccagtcccaggtgcagctggtgcagtctggggctgaggtgaagaagcctgggtcctcggtgaagtctcctgcaaggcttctggaggcaccttcttcagctatgcttttatttggtggcgacaggccctggacaagggcttgagtgctggggagggatcatccctatctttggtgcatcgaattacgcacagaagtttcaggacagagtcaccattaccgcgacgaatcacgagtacagcctacatggagctgagcaggctgagatctgaagacacggccatctatttctgtgcgagagccctcgtcaactttcatagtccctctcatagtccccacacatggaaattggttcgacccctggggccagggaaccctggtcaccgtctcctcagcttccaccaagggccatcggtcttcccctggcgccgcctgctccagagcacctctgggggcacagcggccctgggctgcctggtcaaggactacttcctatatactgtctgagcgggctggcaggcgcatag

SEQ ID NO: 791917 - DNA, 722 bp, Homo sapiens
  misc_feature: 40007.44.85.H08.1.pb.heavy.1.raw 40007
ctatgcgccttgccagcccgctcagacagtatataggaagtagtccttgaccaggcagcccagggccgctgtgccccagaggtgctcttggaggagggtgccagggggaagaccgatggcccttggtggaggctgaggagacggtgaccgtggtcccttgggcccagacgtccataccgtagtagtagtcccagcaggtggtagtactacaatatgtcctcgcacagtaatacacagccgtgtcctcggctctcaggctgttcatttgcagatacagcgggtgttcttggaattgtctctggagatggtgaatcggcccttcacggagtctgcatagtatttattacttccatcataccatataagtgccaccccctccagccttgcctggagcctggcgacccagtgcatgccataggtactgaaggtgaaatccagacgctgcacaggagagtctcaggggacctcccaggctggaccacgcctccccagactcaccagctgcacctgacactggacacctcttaaaagagcaacgaggaaaacccagctcagccccaaactccatggtgagtcctctgtgttcagtgctgatcaccgaatggagaacacccgccgacttctagtgctggctcctctcccagagctccccgcgactgagtgatactaaatcgagcaccggtcgtgtatatactgtctgatggcgcgagggaggcgatacg

SEQ ID NO: 791918 - DNA, 649 bp, Homo sapiens
  misc_feature: 40044.44.86.H09.1.pb.heavy.1.raw 40044
ctatgcgccttgccagcccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataacggccgtgtccgcggcggtcacggaggtcagtttcaggagaagcggttcatggacgtgtccctcgaaatggtgagacgactcttgagggacggagagtagtacgtcgccccagtataatggatgtcaccaatccactccattcccctccctggggctgcggatccagccccaagaatgatcagaactgatggaaactccagagacagtgcagatgagagacagggttcccgaaggcctcaccagtcctgggcccgactcctgcagctgcacctgggacaggacccatctggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 791919 - DNA, 654 bp, Homo sapiens
  misc_feature: 40048.44.23.C01.1.pb.heavy.1.raw 40048
cgtatcgcctccctcgcgccatcagacagtatatacacgaccggtgctcgatttagtacacgtgattagggattggggctttctgagagtcaaggacctccctgtgcaagaacatgaagcacctgtggtttttcctcctgctggtggcagctcccagatgggtcctgtcccaggtgcagctgcaggagtcgggcccaggactggtgaggcttcgggaaccctgtctctcatctgccactgtctctggagtttccatcagttctgatcattcttgggggctggatccggcagcccccaggggagggaatggagtggattggtgacatccattatactggggcgacgtactactctccgtcccctcaagagtcgtctcaccatttcgagggacacgtccatgaaccgcttctccctgaaactgacctccgtgaccggccgcgacacggccgtttatttctgtgcgaggcgagactggtctttcaatctatggggccgtggcaccctggtcactgtctcctcagcttccaccaagggcccatcggtcttcccctgggcgcctgctccaggagcccctctgggggcacagcggccctgggcctgcctggtcaaggactacttcctatatactgtctgagcggctggcaaggcgcatag

SEQ ID NO: 791920 - DNA, 715 bp, Homo sapiens
  misc_feature: 40094.44.55.E11.1.pb.heavy.1.raw 40094
cgtatcgcctccctcgcgccatcagacaggtatatacacgaccggtgctcgattagcactcgcacgttgggttttgggcgagaggagccccagcactgggattccgaggtgttttccattcgcgtgatcagcactgaacacagaggactcaccatggagttttggctgagctgggttctccttgttggacttttaaaaggtgtccaggtgtgaggtgcggctgatggagtctggaggaggcttagtccagcctggggggtcccagagactctcctgtgcaggcctctgggctcaccgtcagcagcaactacatgagttggggtcggccaggctccagggaaggcggctggagtgggtctcagtcatttatactggtgatttcacatactacgcagactccgtgagggggccgattcaccatctccagggacaattccaggaacacggtttatcttcaaatgaacaacctgagaggcgacgacaacggccgtctattactgtgcgagacaagtcggccctcggagtggcttattattcgtttgacttctggggccagggaaccctggtcaccgtcgcctcgccctccaccaagggcccatcggtcttccccctggcaccctcctccaagagcacctctgggggcacagcggccctgggctgcctggtcaaggactacttcctatatactggtctgagcgggctggcaggcgcatag

SEQ ID NO: 791921 - DNA, 663 bp, Homo sapiens
  misc_feature: 40135.44.29.C07.1.pb.heavy.1.raw 40135
ctatgcgccttgccagcccgctcagacagtatataggaagtagtccttgaccaggcagcccagggccgctgtgctctcggaggtgctcctggagcagggcgccaggggaagaccgatgggcccttggtggaggctgaagagacggtgaccattgtcccttggccccagatatcaaagccactcacataaccaccacttttataatagttgatcatgtgtgcgcagtagtatgtggctgtgtccgcaggggccatgttggccactctaaggatcacctgcgtattggaggcgtctccggtgatggagagtctgctcttcagagatggactgtagcgcctatcatcatcccaataaatgagtgcaagccactccagggcctttcctgggggctgacggacccagcccacaatcgcttccatcactcctgagtgagaacccagagaggttgcaggtcagcgtgagggtctgtgtgggcttcaccagcgtaggaccagactccttcaaggtgatctgggacaagacccatgaagggatggtcagcagcaggagcgtggagcaaagtgtgtccatggtggggcacaggagtccccctttcccttcgtagcactctaaatcgagcaccggtcgtgtatatactgtctatggcgcgagggaggcgatacg

SEQ ID NO: 791922 - DNA, 688 bp, Homo sapiens
  misc_feature: 40140.44.45.E01.1.pb.heavy.1.raw 40140
cgtaatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggtttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggttccgccaggctccaggcaaggggctggagtgggtggcagtcatctggtctgatggaagtaaagaatactatggaaactccgtgaagggccgattctccgtctccagagacaattccaagaaacaccgtggtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggaggcacctccgagagcacagcggccctgggctgcctggtcaaggactacttcctatatactgtctgagcgggctggcaaggcgcatag

SEQ ID NO: 791923 - DNA, 674 bp, Homo sapiens
  misc_feature: 40193.44.73.G07.1.pb.heavy.1.raw 40193
ctatgcgcctgccagccgctcagacagtatataggagtgtcttgaccaggcagccagggccgctgtgctctcggaggtgctcctggagcagggcgccaggggaagaccgatgggccttggtggaggctgaggagacggtgaccagggttcctggccccagtagtcaagcgggaccgtctcgaggggctctcgcacaataatagacagccgtgtcctcacttgtgaggttgtacattgcagatgcagtgtgttcctggaattgtctctggagacggtgaatcggcccttctcggagtctccgtagtgttcttcattccatcttctgatataatgccacccactccagccccttgcctggagcctggcggacccagtgcatggcataggtcctgaagatgatccagaggctgcacaggagagtctcagggttcccaggctgggccgctcctccccagactccactagctgcacctgacactggcaccttcttaaaagagcaacgaggaaaacccatctcagcccaaagtccatggtgagtcctctgtgttcagtgatgatcacgaatggaaacaccggcgacttccagtgctgggctcgtctcccccctgagcgtagagctaaatcgagcaccggtcgtgtatatactgtctgatggcgcgagggaggcgatacga

SEQ ID NO: 791924 - DNA, 689 bp, Homo sapiens
  misc_feature: 40197.44.45.E01.1.pb.heavy.1.raw 40197
cgtatcgcctccctcgcgccatcagacagtatatacacgaccggtgctcgatttagtgagtcagtaaggaaagggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccagggcaaggggctggagtggggtggcagtcatctggtctgatggaagtaaagaatactatgggaaactccgtgaaggggccgattctccgtctccagagacaattcaagaacaccgtgtatctacaaatgaacaatttgagagccgaggactcggctctctctattattgtacgagccatcgtttctactggggccagggagccctggtcaccgtctcctcagcctccaccaagggcccatcggtcttcccctggcgccctgctccaggagccacctccgagagcacagcggccctgggctgcctggtcaaaggactacttcctatatactgtctgagcgggctggcaaggcgcatag

SEQ ID NO: 791925 - DNA, 649 bp, Homo sapiens
  misc_feature: 40274.UNK.UNK.UNK.pb.heavy.1.raw 40274
cgtatcgctcctccccgccgcgccatcagaccaggtatatacacgaccggtggctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagccccagggagggaatggagtgattggtgacatccattatactggggcgacgtactactctccgtccctcaagagtcgctcaccatttcgagggacactccatgaaccgcttctcctgaaactgacctccgtgaccgccgcggacacggcgtttatttctgtgcgaggcgagactggtctttcaatctatgggccgtggcaccctggtcactgttctcctcagcttccaccaagggcccatcggtcttccctggcgccctgctccaggagcacctctgggcacagcggccctgggctgcctgtcaaggactactttcctatatactgtctgagcggctggcaaggcgcataga

SEQ ID NO: 791926 - DNA, 662 bp, Homo sapiens
  misc_feature: 40314.44.12.B01.1.pb.heavy.1.raw 40314
cgtatcgcctccctcgcgccatccagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcggcccaggactggtgaagccttcggagaccctgtccctcacctgcactgtctctggtggctccatcagcagtagtagttactactggggctggatccgccagccccagggaaggggctggagtggattgggagtatctattatagtgggagcacctactacaacccgtcctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaaggcccatcggtcttccccctggcaccctcctccaagagcacctctgggggcacagcggccctgggctgcctggtcaaggactacttcctatatactgtctgagcgggctggcaaggcgcatag

SEQ ID NO: 791927 - DNA, 665 bp, Homo sapiens
  misc_feature: 40315.44.12.B01.1.pb.heavy.1.raw 40315
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactgggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttccatatactgtctgagcgggctggcaaggcgcatag

SEQ ID NO: 791928 - DNA, 698 bp, Homo sapiens
  misc_feature: 40327.UNK.UNK.UNK.pb.heavy.1.raw 40327
ctatgcgccttgcagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctgccccagaagtcaaacgaataataaccactccgagcgccgacttgtctcgcacagtaatagacggccgtgtcgtcgcctctcaggttgttcatttgaagataaaccgtgttcctgaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccgtcgtgtatatactgtctggtggcgcgagggaggcgatacg

SEQ ID NO: 791929 - DNA, 703 bp, Homo sapiens
  misc_feature: 40329.UNK.UNK.UNK.pb.heavy.1.raw 40329
cgtatcgcctccctccgcgccatcagacagtatatacacgacccggtgctcgatttagctgcgtcacgatctctcttggggagctctgagagcgggagccccagcccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaagggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 791930 - DNA, 669 bp, Homo sapiens
  misc_feature: 40331.UNK.UNK.UNK.pb.heavy.1.raw 40331
ctatgcgccttgccagcccgctcagacagtatataggaagtagtccttgaccaggcagcccagggccgctgtgcccccagaggtgctcctggagcaggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatgggagactgtgtctgtggacttgtccgcggtaatcgtaattctgccccggaagtctcgtgcgtaggtgagtgagcccaaaaagagggatgattccacccatccactcaagccctgtccagggcctgcgcacccagttgatggtatacagtagtggaactggtagtacttccagaggccgtgcaggaaagggtcaccgaggaccaggttgcggcattctagtcccagactgcaccagttgcaccagggactggacacctgttgctgctgccaccacaaagaggaacctccaggtccagtcatggtgatgagctgtgctccagggcttctttagaggaggaatgtggttgtcagtagatctaaatcgagcaccgtcgtgtatatactgtctgatggcgcgagggaggcgatacg

SEQ ID NO: 791931 - DNA, 706 bp, Homo sapiens
  misc_feature: 40360.44.27.C05.1.pb.heavy.1.raw 40360
ctatgcgccttgccagcccgctcagacagtatataggaagtagtccttgaccaggcagcccagggccgctgtgctctcggaggtgctcctggagcaggcgccagggggaagacgatgggcccttggtggaggccgaggagacggtgaccaggttccctggccccaggcgtcgaatgaaccgatttggaaacagatagtctcgcacaaaaatacacggcgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatatccaattatcgaaggtgaatccagaggctgcacaggagagtctcagggacccccctactgggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaaaacccttcgatcgcgtctaaaatcgagcaccggtcgtgtatatactgtctgatggcgcgagggaggcgatacg

SEQ ID NO: 791932 - DNA, 706 bp, Homo sapiens
  misc_feature: 40362.44.36.D03.1.pb.heavy.1.raw 40362
cgtatcgcctcctcgcgcccatcagacagtatatacacgaccggtgctcgatttagctgcgtcacgatctctcttggagctctcagagaggtgccttagccctggattccaaggcatttccacttggtgatcagcaatgaacacagaggactcaccatggagttggggctgcgctgggttttccttgttgctattttagaaggtgtccactgtgaggtgcggctggtggagtctgggggaggcttggtacagcgggggggtcctgagactctcctgtgcagcctctggattcatcttcagtgactatgccatgaactgggtccgccaggctccagggaacggggctggagtggtttcataatgttaatatgctggagataccacctactacgcagactctgtgaagggccgattcaccaattccagggacaatgccaagaactcactgtatctggaatgaacagcctgagagacgaggacacggctgtctacttctgttcgagagatcgggccacttggtcagtggctggttttgactactggggccggggaaccctggtcaccgtctcctcagcctccaccaagggcccatcggtcttccccctggcgccctgctccaggagcacctccgagagcacagcggccctggctgcctggtcaggactacttcctatatactgtctgagcgggctggcaaggcgcatag

SEQ ID NO: 791933 - DNA, 701 bp, Homo sapiens
  misc_feature: 40367.UNK.UNK.UNK.pb.heavy.1.raw 40367
cgtatcgcctccctcgcgccatcagacagtatatacaccgaccggtgctcgatttagctgcgtcacgatctctcttgggagctctgagagcggagcccagccccagaattcccaggtgttttcatttggtgatcagcactgaacacagaggactcaccatggagttcgggctgagctgggttttccttgttgttattttacaaggtggtccagagtgaagtgcagttggtggagtccgggggagactggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 791934 - DNA, 542 bp, Homo sapiens
  misc_feature: 40371.44.38.D05.1.pb.heavy.1.raw 40371
cgtatcgcctccctcgcgccatcagacagtatatacacgaccggtgctcgatttagtatctgatagttgggtttggggggtcctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggcgattcaccatctccagagacaacgccaagaacacgctgtatctgcaaatgaacagtctgagagccgaggacacggctgtgtattactgtgcaagagccggtgcgggagttcggggagttgcatactactactacgggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 791935 - DNA, 679 bp, Homo sapiens
  misc_feature: 40381.UNK.UNK.UNK.pb.heavy.1.raw 40381
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagcccttgcctggagcctggcggaccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctccagcccctttcccttactgactcactaaatcggcaccgtcgtgggtatatactgtctgatggcgcgagggaggcgatacg

SEQ ID NO: 791936 - DNA, 607 bp, Homo sapiens
  misc_feature: 40383.UNK.UNK.UNK.pb.heavy.1.raw 40383
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttgggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791937 - DNA, 654 bp, Homo sapiens
  misc_feature: 40461.44.86.H09.1.pb.heavy.1.raw 40461
gcgccttgccagcccgctcagacagtatataggaagtagtccttgaccaggccagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggaccccatctgggagctgccaccagcaggaggaaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 791938 - DNA, 695 bp, Homo sapiens
  misc_feature: 40465.44.36.D03.1.pb.heavy.1.raw 40465
cgtatcgcctccctcgcgccatcagacagtatatacacgaccggtgctcgatttagctgcgtcacgatctctcttgggggagagcggagccccagccccagaattcccaggtgtttttcattggtgatcagcactgaacacagaggactcaccatggagttcgggctgagctgggttttccttgttgttattttacaaggtgtccagagtgaagtgcagttggtggagtcgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactacctgaaaaccgaggacacgggcatgtattattgtgttgtgtttatatcaggaactgtccactgggccagggaaccctggtcaccgtctcctcagctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791939 - DNA, 603 bp, Homo sapiens
  misc_feature: 40478.44.23.C01.1.pb.heavy.1.raw 40478
ctatgcgccttgccagcccgctcagacagtatataggaagtagtccttgaccggcagcccagggccgctgtgccccagaggtgctcctggagcagggcgccaggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactctgagggacggagagtagtacgtcgcccagtataatgatgtcacaatcactccattcccctccctggggctgcggatccagccccagaatgatcagaactgatggaaactccagagacagtgcagatgagagacagggttcccgaaggcctcacagtcctgggcccgactcctgcagctgcacctgggacaggacccatctgggagctgccacagcaggaggaaaaacacaggtgttcacctgccccaatcctaatcacgtgtactaaatcgagcaccggtcgtgtatatactgtctgatggcgcgagggaggcgatacg

SEQ ID NO: 791940 - DNA, 757 bp, Homo sapiens
  misc_feature: 40499.UNK.UNK.UNK.pb.heavy.1.raw 40499
ctatgcgcccttgccagccccgctcagacagtatatagggaagtagtcccttgacccaggcagccccagggccgctgtgcccccagaggtgctcttggaggagggtgccagggggaaggaccggatggcccttggtggaggcggaggcgggacggtgacccagggttccctgggccccagaagtcaaacgaataataaccactccggagcgccgacttgtctcgcacagtaatagaccggcccgtgtcgtcgcctctcaggtttgttcatttgaagataaacccgtgtttcctggaattgtcccctggaatggtgaatcggccccttcacggagtctgcgtagtatgtggaaatcaccagtataaatgactgaggacccactccaagccccttccctggagcctgggcggaccccaactcatgtagttgctgctgacggtgaagccccagaggctgcccacaggagagtctctggggaccccccaggctggactaagccctcctccagacctccatcagccgcacctcacactggacaccttttaaaagtccaacaaggagaacccagctcagccaaaactccatgggtgagtccctcttggggttcagtgctgatcaccgaatgggaaacccacctcggaatcccagtgctggggcctctctcccccccaaaccccaacgtgcgagtggctaaatcggagccaccggtcccgtgtatatactgtggtctggatggcccgagggagggcccgatacg

SEQ ID NO: 791941 - DNA, 665 bp, Homo sapiens
  misc_feature: 40511.44.12.B01.1.pb.heavy.1.raw 40511
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaaacccgtccctcaagagtcgagtcaccatatcagtagacacgtccaagaaccagttctccctgaagctgagctctgtgaccgccgcggacacggccgtgtatactgtgcgagagtagggcagttcgtcaccaactactttgaccactggggcagggaaaccctggtcccgtctccctcagcctccaccaagggcccatcggtctttccccctggcaccctcctccaagagcacctctgggggcacagcggccctgggctgcctggtcaaggactacttcctatatacttctgagcgggctggcaaggcgcatag

SEQ ID NO: 791942 - DNA, 665 bp, Homo sapiens
  misc_feature: 40572.44.6.A06.1.pb.heavy.1.raw 40572
cgtatcgcctcctcgcgcatcagacagtattacacgaccggtgctcgattagatctactgacaaccacattcctcctctaaagaagcccctgggagcacagctcatcaccatggactggacctggaggttcctctttgtggtggcagcagcaacaggtgtccagtccctggtgcactggtgcagtctgggactagaatgccgcaaccttggtcccggtgaccctttcctgcacgcctctggaagtactaccagttccactacttataccatcaactggtgcccaggcccctggacaagggcttgagtggatgggtggaatcatcctcttttggctcactcacctacgcacgagactttccggggcagattacgattaccgcggacaagtccacagacacagtctccatgacaatgagttctttgaaatccgacgacacggccgtctactactgtggcgagagttccgtaccccagctcgcatggagcctttgagatcctgggggcagggaaccctggtcattgtcacctcagcttccaccaagggcccatccgtcttccccctggcgccctgctccaggagcacctctggggcacagcggccctgggctgcctggtcaaggactacttcctatatactgtctgagcgggctggcaaggcgcatag

SEQ ID NO: 791943 - DNA, 669 bp, Homo sapiens
  misc_feature: 40585.44.27.C05.1.pb.heavy.1.raw 40585
ctatgcgccttgccagccgctcagacagtatatggaagtagtcttgaccaggcagccaggccgctgtgctctcgaggtgctcctggagcagggcgccaggggaagaccgatgggccttggtggaggcgaggagacggtgaccagggttccctggccccaggcgtcgaatgaacgatttgaaaacagatagtctcgcacaaaaatacaccggccgtgtcctgaggtctcaggctgttcatttgaagagacactgtgttctcgaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggaccccctactgggccacgcctccccagactccacgaattgcacctgacacatgacacctcttaagaggcaacgaggaaaaacccagctcagcccaaactccatggtgagtcctctgtgttcagtgatgatcacgagtggaacaccggcgacttcctcttccccccaaaccttcgatcgcgtctaatcgagcaccggtcgtgatagtatagactgatggcggagggaggcgatacg

SEQ ID NO: 791944 - DNA, 599 bp, Homo sapiens
  misc_feature: 40591.44.36.D03.1.pb.heavy.1.raw 40591
cgtatcgcctccctcgcgccatcagacagtatatacacgaccggtgctcgatttagctgcgtcacgatctctcttgggtcttgtcccaggtcaccttgaaggagtctggtcctgtgctgtgaaacccacagagaccctcacgctgacctgcaccatctctgggttctctctcaacgatattagaatgggtgtgagctggatccgtcagccccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacggtaatgcgggaagaaacagctggtttctgtattataagtcttaccatctggacgtctggggcaaaggaccacggtcaccgtctcctcagcttccaccaagggcccatcgtcttcccctggcgccctgctccaggagcacctctggggcacagcggccctggctgcctggtcaaggactacttcctatatactgtctgagcgggctggcaaggcgcat

SEQ ID NO: 791945 - DNA, 630 bp, Homo sapiens
  misc_feature: 40615.UNK.UNK.UNK.pb.heavy.1.raw 40615
cggccggacagcgcttgcagggaccttggagctaaggacgacatattgcctttagaccagtcgaaggtgagcttagctaccactgaacgtttaggcgccagatgcggtctgggtgaccgtaaactcgcagcttatcgatgatcctactgcacgcctcaaccaaccaggtcttggatgcgcgcgataggactgaccggatcgctacagacatttaactcgctagtaacttaattgagatcctaggggatgggatagggaaatagaatccagcccctatccacgcgccccacatagcctgagccttggggtgtatctgagtttacttttatttcgtgttggaatgagttgaacttccggagtggagtaatggtgtttgtcttctttcccctacgcaaagtactagtttttacgagtggcgttgacaagccatagcacagtcgacaggtaataaacaattaacgtggcgtaaagattggccgcttgctgtgggcattgcaagctgggttctgcagcaattgtgcactgctagacgacaatatgaatctgcggaccccctagtggccaaagatggccgctagcggttccgcagcttttgacctggaccaggggtgcatagcctgcccagccttc

SEQ ID NO: 791946 - DNA, 615 bp, Homo sapiens
  misc_feature: 40636.UNK.UNK.UNK.pb.heavy.1.raw 40636
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcgggccaatctttacgccacgttgaattgtttattacctgtgactggctatggcttgcaacgccactcgtaaaactagtactttgccggttaggggaagtagacaaacccattactcccactttcccggaagttcaactcattccaaccacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgaggcgtgcagtagatcatcgataagctgcgagttagggtcatcccagaccgcatctggcgcctaaaacgttcagtggtagctaaggcgtcaccttcgaactgtctaaaggcaatatgtcgtccttagctccaagtccctagcaggcgtgtcg

SEQ ID NO: 791947 - DNA, 702 bp, Homo sapiens
  misc_feature: 40637.44.36.D03.1.pb.heavy.1.raw 40637
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtcactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791948 - DNA, 709 bp, Homo sapiens
  misc_feature: 40680.44.36.D03.1.pb.heavy.1.raw 40680
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggaccccccccgctgtaccaagcctcccccagactccaccagccgcacctcacagtggacaccttctaaaatagcaacaaggaaaacccagcgcagcccaactccatggtgagtcctctgtgttcagtgctgatcaccaagtggaaatgccttggaatccaggctaaggcacctctctgagagctcccaagagagatcgtgacgcagctaaatcgagcaccggtcgtgtatatactgtctgatggcgcgagggaggcgatacg

SEQ ID NO: 791949 - DNA, 671 bp, Homo sapiens
  misc_feature: 40701.UNK.UNK.UNK.pb.heavy.1.raw 40701
cgtatcgcctccctcgcgccatcagacagtatatacacgacggtgctcgatttagcacacgatagttgggttggggatactttctgagactcatgggcctcctgcacaagaacatgaaacacctgtggttcttcctctcctggtggcacctcccagatgggtcgtgtccgaggtgcagctgcaggagtcgggcccaggacgggtgaagccttcggagaccctgtcctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcgaactggctcgacccctggggccaggaaccctggtcaccgtctcctcagcctccaccaagggcccatcggtcttccccctggcaccctcctccaagagcacctctggggcacagcggccctgggctgcctggtcaaggactacttcctatatactgtctgagcggctggcaaggcgcatag

SEQ ID NO: 791950 - DNA, 722 bp, Homo sapiens
  misc_feature: 40724.44.56.F01.1.pb.heavy.1.raw 40724
cgtatcgcctccctcgcgccatcagacagtatatacacgaccggtgctcgattttagcagacgtctgaacacacaaaggggctgggagaggagccccagccgtgagattcccaggagttttccacttggtgatcagcactgagcacagaccaccaaccatggagtttgggctaatcttgatttttccttgtagttttttttagaaggtgtccagtgcgaggggcgactggcggagtcggggggggcttggcacagccagggcggtctctgagactctcctgtgtagtctcaggattcagtcttagtgattatcacttggcctgggtccgttcaggctccagggaaggggcttgagtggatcactttcgtcagaatgaaaacgttatggtggaaagtaaagagtacgccgcgtctgtgaagggaagatttcaccgtctcaagggatgactccaacagtgttggccatttacaaatgagcaacctgaagacccgacgacacaggcgtctatttactgcgccaggcgatcctgggacgtcgatgcatttgatatttggggccaggggaacaatggtcaccgtctcttcagcttccaccaagggcccatcggtcttccccctggcgccctgctccaggagcacctctgggggcacagcggccctgggctgcctggtcaaggactactttcctatatactgtctgagcgggctggcaaggcgcatag

SEQ ID NO: 791951 - DNA, 586 bp, Homo sapiens
  misc_feature: 40770.44.78.H01.1.pb.heavy.1.raw 40770
cgtatcgcctccctcgcgccatcagacagtatatacacgaccggtgctcgatttagtgtgagtagtttgggtttgggtgccgaagttgcctggaggtcacggtcaccacgctgctgaggtgaagaagcctggggcctcagtgacagtctcctgcacggcttctggatacacgttcatcaattatgatattaactgggtgcgacacggccgctggacaaggggctggagtggatgggatggatgaagccctatagttggcaacacgggctttgcccagaagttccaaggcagagttagtatgaaccaggagcacctccccaggtacagtctacatggaactgagcagcctgagatctgaggacacggccccggcgtgtatttctgtgcgagagccaccagcacctggcttgacttgtggggccagggaacctggtcaccgtctcctcagcctccaccaagggcccatcggtcttccccctggcgcctgcttccaggagcaccctccgagagcacagcggccctgggctggcctggtcaaggactacttccctatatactggtctgagcgggctggcaaggcgcatag

SEQ ID NO: 791952 - DNA, 540 bp, Homo sapiens
  misc_feature: 40776.44.38.D05.1.pb.heavy.1.raw 40776
cgtatcgcctcctcgcgccatcagacagtatatacacgaccggtgctcgatttagtatctgatagttgggtttggggggtccctgagactctcctgtgcagcctctggattcaccttcagtagctactggatgcactgggtccgccaagctccagggaaggggctggtgtggggtctcacgtattaatagtgatgggagtagcacaagctacgccggactccgtgaaggccgattcaccatctccagagacaacgccaagaacacgctgtatctgcaaatgaacagtctgagagccgaggacacggctgtgtattactgtgcaagagccggtgcggagttcggggagttgcatactactactacgtatggacgtctgggccaagggaccacggtcaccgtctcctcagcttccacaagggcccatcggtctccccctggcgccctgctccaggagcacctctgggggcacagcggccctgggctgcctggtcaaggactacttcctatatactgtctgagcgggctggcaaggcgcatag

SEQ ID NO: 791953 - DNA, 668 bp, Homo sapiens
  misc_feature: 40783.44.12.B01.1.pb.heavy.1.raw 40783
cgtatcgcctcctcgcgccatcagacagtatatacacgaccggtgctcgattagtagtgtagattccgcggggcttctgagagtcatggacctcctgtgcaagaacatgaagcacctgtggttcttcctcctgctggtggcggctcccagatgggtcctgttccagctgcagctgcaggagtcggcccagactggtggaagccttcggagaccctgtccctcacctgcactgttctctcggtgggctccatcagcagtagtagtttactactggggctggatccgccaggcccccagggaaggggctggagtgggattgggaggtatcattatagtgggagcacctactacaacccgtccctcaaagagtcgagtcaccatatcagtagacacgtcccaagaaccagtttctccctgaagctgagctctgtgaccggccgcggacacggccgtgtattacgtgcgagagtagggcagttcgtcaccaactactttgaccactgggggccagggaaccctgtcaccgtctcctcagcctccaccaaaggcccatcggttcttcccctggcacactcctccaagagcacctctggggcacagcggccctggctgcctggtcaaggactacttcctatatactgtctgagccgggctggcaaggcgcatag

SEQ ID NO: 791954 - DNA, 689 bp, Homo sapiens
  misc_feature: 40788.UNK.UNK.UNK.pb.heavy.1.raw 40788
ctatgcgccttgccagccccgctcagacagtatataggaagtagtctctgacgcaggcagccccaggcgctgtgctctcggagggcgtgctcctggagcagggcgccaggggaagaccgatgggccttggtgaggctgaggagacggtgacagggttcctggcccaggtggacagttcctgatataaacacaaccaataatacatgccgtgtctcggttttcaggttagtcattcgcagaatcaaatgagttttgaagtcagtctcttgagaggcgtgatctggcttcacagacgcggcgtactctgtgataaagctggcaacttgttttactgcgcaagccactccagccccttcctggagcctggcggacccggagtccatgataagtggtcactgatggtgatccagaggcgacacaggagagttctcagggaccctccaggctgaccaagtctccccggactccaccaactgcacttcacttggacaccttgtaaaataacaacaggaaacccagctcagcccgaactccatggtgagtcctctgtgttcagtgctgatcaccaaatgaaaacacctgggaattcggggctgggctcgctctcagagctcccaagaggatcgtgacgcagctaaatcgagcacggtcgtgtatatactgtctgatggcgcgagggaggcgatacg

SEQ ID NO: 791955 - DNA, 713 bp, Homo sapiens
  misc_feature: 40840.UNK.UNK.UNK.pb.heavy.1.raw 40840
cgtatcgcctccctcgcgccatcagacagtatatacacggaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcgggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtgggaagtaaagagtacgccgcgtctgtgaagggaagattcaccgtctcaagggatgactccaacagtgttggccatttacaaatgagcaactgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 791956 - DNA, 563 bp, Homo sapiens
  misc_feature: 40850.UNK.UNK.UNK.pb.heavy.1.raw 40850
ctatgcgccttgccagcccgctcagacagtatataggaagtagtcttgaccaggcagcccaggccgctgtgctctcgagtgctcctggagcagggcgccagggggaagaccgatggggcccttggtggaggctgaggagacggtgaccagggttcctggccccacaagtcaagccaggtgctggtggctctcgcacagaaatacacgccgtgtcctcagatctcaggctgctcagttccatgtagactgtacctggggaggtgctcctgtcatactaactctgccttggaacttctgggcaaagccgtgttgccactatagggcttcatccatccatccactccagcccttgtccagcgcctgtcgcacccagttaatatcataattgatgaacgtgtatccagaagccgtgcaggagactgtcactgagggcccaggcttcttcacctcagcagcgtggtgaccgtgacctccagcaacttcgcacccaaacccaaactactcacactaaatcgagcaccgtcgtgtatatactgtctgatgcgcgggaggggagcgatacg

SEQ ID NO: 791957 - DNA, 726 bp, Homo sapiens
  misc_feature: 40889.44.85.H08.1.pb.heavy.1.raw 40889
cgtatcgcctccctcgcgccatcagacagtatatacacgaccggtgctcgattagtatcactcagtcgcggggagctctgggagaggagccagcactagaaagtcggcggtgtttccattcggtgatcagcactgaacacagaggactccaccatggagtttgggctgagctgggtttttcctcgttgctcttttaagaggtgtcagtgtcaggtgcagctggtggagtctgggggaggcgtggtccagcctgggaggtccctgagactctcctgtgcagcgtctggattcaccttcagttacctatggcatgccactgggtccgccaggctccaggcaaggggctggaggtgggtggcacttatatgtatgatggaagtaataaatactatgcagactcgtgaagggccgattcaccatctccagagacaattcaagaacaacgcctgtatctgcaaatgaaacagcctgagagcgaggacacggctgtgtattactgtgcgaggacatattgtagtactaccacctgctgggactactactacggtatggacgtctgggccaaggaccacggtcaaccgtctctcagcctcccaccaagggcccatcggtcttcccctggcacctcctccaagagcacctctgggggcacaggcggccctggggctgcctggtcaaggactacttcctatatactgtctgaagcgggctggcaagggcgcatag

SEQ ID NO: 791958 - DNA, 600 bp, Homo sapiens
  misc_feature: 40903.UNK.UNK.UNK.pb.heavy.1.raw 40903
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctaggggatggataggaaatagaatccacccctatcaccccccacatagcctgcttgggtgttgagttactttatttcgtgttggaatgagttgaacttccgggaagtggagtaatgggtttgtctacttcccctacgcaagtactagttttacgagtggcgttggcaagccatagccagtcacaggttataaacaattcaacgtggcgtaaagattggccgcttgctgtgggcattgcaagctgggtttgcagcattgtgcatgctagacgacaatatgaatctgcgggacccctagtggccaagatggccgctagcgggttcgcagcttttgacctggaccagggtgcataggcctgccagccctcc

SEQ ID NO: 791959 - DNA, 709 bp, Homo sapiens
  misc_feature: 40917.UNK.UNK.UNK.pb.heavy.1.raw 40917
ctatgcgccttgccagcccgctcagacagtatataggaagtagtcctttgaccaggcagcccagggccgctgtgctctcggaggtgctcctggagcagggcgccaggggaagaccgatgggccccttggtggaggctgaggagacggtgaccagggttccctggccccagtggacagtttcctgatataaaaccacaacacaataatacatgccgtgtcctcggttttcaggttagtcattcgcagaatcaattgagttcttgaagtcatctcttgagagggtgaatctggctttcacagacgcggcgtactctgtggattaaagctggcaactttgttttttactgcgaccaagccactccagcccccttcccctggagcctggcggacccagtccatatagtggtcactgatggtgaatccagaggcgacacagggagtctcagggaccctccaggctggaccaagtctcccccgactccaccaactgcacttcactctggacaccttgtaaaaataaacaacaaggaaaaccccagctcagccgaactccatggtgagtcccctcctgtgttcagtgctgatcaccaaatgaaaaacactgggaattctgggctgggctccgctctccctcccaagagagatcgtgacgcagctaaatcgagcaccgtcgtgtatatactgtctgatggcgcgagggagcgatacg

SEQ ID NO: 791960 - DNA, 724 bp, Homo sapiens
  misc_feature: 40973.44.36.D03.1.pb.heavy.1.raw 40973
cgtatcgccctccctcggcgccatcagacgtatatacacgaccggtgctcgatttagctgcgtcacgatctctcttggggagctctgagagcggagccccaagccccagaattcccaggtgttttcatttggtgatcagcactgaaacacagaggactcaccatggagttcgggctgagctgggttttccttgttgttattttacaaggtgtggtccagagtgaagtgcagttggtggagtccgggggagaccttggtccagccctggagggtccctgagactctcctgtgtcgcctctggattcaccatcagtgaccactatatggactggggtccgcccaggctccagggaaggggctggagtggcttggcgcgcagtaaaaacaaaggttgccagctttatcacagagtacgccgcgtctgtgaaagccagattcacctctcaaagagatgacttcaagaactcattgattctgcgaatgactaacctgaaaaaccgaggacacgggcatgtattattgtgttgtgtttatatcaggaactgtccactggggcccagggaaaccctggtcaccgtctcctcagcctccaccaagggcccatcggtcttcccctggccggccctgctccaggagcacctccgagagcacagcggccctggggctgcctggtccaaggactacttcctatatacctgtctgagcgggctggcaaggcgcatag

SEQ ID NO: 791961 - DNA, 696 bp, Homo sapiens
  misc_feature: 41009.44.36.D03.1.pb.heavy.1.raw 41009
cgtatcgcctccctcgcgccatcagacagtatatacacgaccggtgctcgatttagctgcgtcacgatctctcttggggagctctgcagagcggagcccagccccagaatttccaggtgtgttttattggtgatcagcactgaacacagaaggactccaccatggagttcgggctgagctgggttttccttgttgttattttacaggtgtccagagtgaagtgcacgttggtggagtccgggggagacttggtccagcctggaggtccctgagactctcctgtgtcgcctctgattcaccatcagtgaccactatatggactggggtccgccaggctccaggaagggctggagtggcttggccgcagtaaaaacaaagttgcagctttatcacagagtacgccgcgttctgtgaaagccagattcaccctctcagagatgacttcaagaactcattgattctgcgaatgactaaacctgaaaaccgaggacacggcatgtattattgtgttgtgtttatatcaggaactgtccactggggccagggaacctggtcaccgtctcctcagctccacaaggcccatcggtcttcccctggcgccctgctccaggagcacctccgagagcacagcggccctggctgcatggtcaaggactacttcctatatactgtctgagcggctggcaaggcgcatag

SEQ ID NO: 791962 - DNA, 689 bp, Homo sapiens
  misc_feature: 41020.UNK.UNK.UNK.pb.heavy.1.raw 41020
cgtatcgcctccctcgcgccatcagacagtatatacacgaccgtgctcgatttagctgcgtcacgatctctcttggggagctctgagagcggagccccagcccagaattcccaggtgttttcatttggtgatcagcactgaacacagaggactcaccatggagttcgggctgagctgggttttcttgttgttattttacaaggtgtccagagtgaagtgcagttgtggagtccgggggagacttggtccagcctggagggtcctgagactctcctgtgtcgcctctggattccatcagtgaccactatatggactgggtccgccaggctccagggaggggctggagtggcttggcgcagtaaaaacaaagttgccagcttatcacagagtacgcccgcgtctgtgaaagccagatcaccctctcagagatgacttcaagactcattgattctgcgaatgactaacctgaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctggctgcctggtcaaggactacttcctatatactgtctgagcggctggcaaggcgcatag

SEQ ID NO: 791963 - DNA, 642 bp, Homo sapiens
  misc_feature: 41024.44.57.F02.1.pb.heavy.1.raw 41024
cgtatcgcctccctcgcgccatcagacagtatatacacgaccggtgctcgatttagctcgatatagttgggtttgggatgctttctgagagtcaaggacctcctgtgcaagaacatgaagcacctgtgtttttcctcctgctggtggcagctcccagatgggtcctgtcccaggtgcagctgcaggagtcgggccaggactggtgaggccttcggaaccctgtctctcatctgcactgtctctggagtttccatcagttctgatcattctggggctggatccggcagccccagggaggggaatggagtggattggtgacatccattatactggggcgacgtactactctccgtcctcaagagtcgtctcaccatttcgagggacacgtccatgaaccgcttctcctgaaactgacctccgtgaccgccgcggacacggccgtttatttctgtgcgaggcgagactgtctttcatctatggggccgtggcaccctggtcactgtctcctcagcttccaccaagggcccatcgtcttcccctggcgccctgctccaggagcacctctgggggcacagcggcctgggctgcctggtcaaggactacttcctatatactgtctgagcgggctggcaaggcgcatag

SEQ ID NO: 791964 - DNA, 691 bp, Homo sapiens
  misc_feature: 41028.44.73.G07.1.pb.heavy.1.raw 41028
cgtatcgcctccctcgcgccatcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 791965 - DNA, 700 bp, Homo sapiens
  misc_feature: 41168.44.55.E11.1.pb.heavy.1.raw 41168
ctatgcgcttgccagcccgctcagacagtatatagaagtagtccttgaccaggcagccagggccctgtgccccccagaggtgctcttggaggagggtgccagggaagaccgatgggcccttgtggaggcggaggcgacggtgaccagggttccctgccccagaagtcaaacgaataataaccactccgagcgccgacttgtctcgcacagtaatagacggccgtgtcgtcgcctctcaggttgttcatttgaagataaaccgtgtttcctggaattgtccctggagatggtgaatcggcccttcacggagtcccgcgtagtatgtgaaatcaccagtataaatggactgagacccactccagccccttccctggagcctggcggacccaactcatgtagttgctgctggacggtgagcccagaaggctgcacaggaagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacaacctcggaatcccagtgctgggctcctctccccaacccacgtgcgagtgctaaatcgagcaccggtcgtgtatatactgtctgatggcgcgagggaggcgatacg

SEQ ID NO: 791966 - DNA, 701 bp, Homo sapiens
  misc_feature: 41173.44.36.D03.1.pb.heavy.1.raw 41173
cgtatcgcctcctcgcgccatcagacagtatatacacgaccggtgctcgatttagctgcgtcacgatctctcttggggagctctgagagcggagccccagccccagaattcccaggtgttttcatttggtgatcagcactgaacacagaaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcaggtgaccactatatggactgggtccgccaggctccagggaaggggctggagtggcttggccgcagtaaaaacaaagttgccagctttatcacagagtacgccgcgtctgtgaaagccagattcacccctctcaagagatgacttcaagaactcattgattctgcgaatgactaacctgaaaaccgaggacacgggcatgtattattgtgttgtgtttatatcaggaactgtcactgggccagggaacctggtcaccgtctctcagcctccaccaagggcccatcgtcttccccctggcgccctgctccaggagcacctccgagagcacagcgccctgggctgcctggtcaaggactacttcctatatactgtctgagcgggctggcaaggcgcatag

SEQ ID NO: 791967 - DNA, 742 bp, Homo sapiens
  misc_feature: 41175.UNK.UNK.UNK.pb.heavy.1.raw 41175
ctattgcgccttgccagcccgctcagaccagtatataggaaagtagtccttgacccaggcagcccagggccgctgtgccccagaggtgctcttggggaggggggtggccaggggaagaccgatgggcccttggtggaggcggaggcgacggtgaccagggttcccctggccccagaagtcaaacgaataataaccacctccgagcgccgacttgtctcgcacagtaatagacggccgtgtcgtcgcctcttcaggttgtttcatttgaaagataaaccgtgtttcctggaattgtcccctggagatgggtgaatcgggcccttcacggagtctgcgtagtatgtgaaatcacccagtataaatgactgaggacccactccagccccttccctggagcctggcggacccaaactcatggtagttgcttgctgacggtgagcccagaggctgcacaggaggagtctcctggaaccccccagggctgggactaagcctcctcccagaactccatcagccgcaacctcacactggacaccttttaaaagtcccaacaaggagaacccagctcagcccaaaactccatggtggagtcctctgtttcagtgctgatcaccgaatggaaacaccttcggaattcccagtgctgggctcctctcccccccaaacccaacgtggcgagtgctaaatcgaggcaccggtcgtgttatatactgtctgatggcggcgggagggaggcgatacg

SEQ ID NO: 791968 - DNA, 686 bp, Homo sapiens
  misc_feature: 41279.44.73.G07.1.pb.heavy.1.raw 41279
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaacccagctcagcccaaactccatggtgaagtcctctgtgttcagtgctgatcaccgaatggaaacaccgccgagagcacagcggccctgagcgtagagctaaatcgagcaccggtcgtgtatatactgtctgatggcgcgagggaggcgatacg

SEQ ID NO: 791969 - DNA, 604 bp, Homo sapiens
  misc_feature: 41347.UNK.UNK.UNK.pb.heavy.1.raw 41347
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccatctttacgccacgttgaattgtttattacctgtgactggctatggcttgcaacgccactcgtaaaactagtactttgcgttaggggaagtagacaaacccattactccacttcccggaagttcaactcattccaacacgaaataaagtaaactcaacacccccaagcaggctatgtgggggggtgataggggtggattctatttcctatccatcccctaggatctcaattaagttactagcgagttaaatgtctgtagcgatcccgtcagtcctatcgcgcgcatcaagacctggttggtttgagcgtgcagtagatcatcgataagctgcgagttaggtcatccagaccgcatctggcgcctaaacgttcagtggtagctaaggcgtcaccttcgactgtctaaaggcaatatgtcgtccttagctccaagtccctagcaagcgtgtcggg

SEQ ID NO: 791970 - DNA, 675 bp, Homo sapiens
  misc_feature: 41361.UNK.UNK.UNK.pb.heavy.1.raw 41361
ctatgccgccttgccaagcccgctcagacagtataataggaagtagtccttgaccaggcagcccagggcccgctggtgcccccagaggtgcttcctggagcagggcgccagggggaaagaccgatgggcccttggtggaagctgaggagacagtgaccagggtgccacggccccatagattgaaagaccagtctcgcctcgcacagaaataaacggccgtgtccgcggcggtcaacggaggtcagtttcagggagaagcggttcatggacgtgtccctcgaaatggtgagacgactcttgagggacggagagtagtacgtcgccccagtataatggatgtcaccaatccactccattcccctccctggggggctgccggatccagcccccaagaaatgatcagaaactggatggaaacttccagagacagtgcagatgagagacagggttcccgaaggcctcaccagtcctgggcccgactcctgcagctgcacctgggacaggacccatctgggagctgccaccagccaggaggaaaaaccacaggtgcttcatgtttcttgcacagggaggtccttgactctcagaaagcatccccaaacccaagtctatagcactaaaatcggagcaccggtcgtgtatatactgtctgatggcgggaggggggcgattacg

SEQ ID NO: 791971 - DNA, 700 bp, Homo sapiens
  misc_feature: 41415.44.73.G07.1.pb.heavy.1.raw 41415
ctatggcgccttgccagcccgctcagacagtatataggaagtagtccttgaccaggcagcccagggcgctgtgctctcggaggtgctcctggagcagggcgccagggggaagaccgatgggcccttggtggaggctgaggagacggtgaccagtgtcccctggcccagtgaaacgcccgataatagctgctgccacttcccgatctcgcacagtaatacagagccgagtcctcgcctctcaggctgatcatttccaggtacagagtgttccggaattgtctctggagatggtgaatcggcccttcacggagtctgcataatatctagaagttccatcatatgctataactgccaaccactccggccccttgcctggagcctggcgacccagtgcatgccagaactactgaaactaaatccagaggcttcacaggagagtctcaggacctcccaggctggaccacgctccccagactccaccaggtgcacctgacactggacacctcttaaaagagtaacgaggaaaaccagctcagcccaaactccatggtggagtcctctgtgttcagtgctgatcaccgaatggaaacaccgccgacttctagtgctgggctcctctcccagagctcccctgagcgtagagctaaatcgagcaccggtcgtggtatatactgtctgatggcgcgagggaggcgatacg

SEQ ID NO: 791972 - DNA, 708 bp, Homo sapiens
  misc_feature: 41423.44.55.E11.1.pb.heavy.1.raw 41423
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggctttagtccagcctggggggtccagagactctccttgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacacctgagaggcgacgacacggccgtctattactgtgcgagacaagtcggcgctcggagtggttattattcgtttgacttctggggccagggaaccctggtcaccgtcgcctccgcctccaccaagggcccatcgggtcttcccccctggcaccctcctccaagagcacctctgggggcacagcggccctgggctgcctggtcaaaggactacttcctatatactgtctgagcgggctggcaaggcgcatag

SEQ ID NO: 791973 - DNA, 677 bp, Homo sapiens
  misc_feature: 41464.UNK.UNK.UNK.pb.heavy.1.raw 41464
ctatgcgccttgccagccccgccagacagtatataggaagtagtccttgaccaggcagcccagggccgctgtgctctcggaggtgctcctggagcagggcgccaggggaagaccgatgggcccttggtggaggctgaggagacggtgaccagggttcccctggcccgaatgaaaccatcccagacagtaatagacggctgtgtcctcggtgttcaggctgttcatcctgcagagacaccgtatcttttgaatcatctcttgagatggtgaatctgctttcacggtgcagcgtagtctgctgtccacgtcagctttggttctaatacggccaacccactccagccccttccctggagcctggcggacccaggtcatccaggcgtcttactgaaagtgaatccagaggctgcacaggaagagtctaagggactcccaggctttaccaaaccccccccagactccaccactgcacctcacaactggacacctttaaaatagcagcaaggaaaatccacctcagcccaaactcatggtgagtcctctgtgttcagtcctgatcactgaatgaaaacacctggaatcccaaggctggggctcctctccagagctcaaccactctctctaaaatcgagcaccggtcgtgtatatactgtctgatggccggagggaggcatacg

SEQ ID NO: 791974 - DNA, 677 bp, Homo sapiens
  misc_feature: 41470.44.45.E01.1.pb.heavy.1.raw 41470
ctatgcgccttgccagcccgctcagacagtatataggaagtagtccttgaccaggcagcccagggccgctgtgctctcggaggtgctcctggagcagggcgccagggggaagaccgatggcccttggtggaggctgaggagacggtgaccagggctcctggcccagtagaacgatgggctcgtacaataatagagagccgagtcctcggctctcaaattgttcatttgtagatacacggtgttcttggaattgtctctggagacggagaatcggcccttcacgagttttccatagtattctttacttccatcagaccagatgactgccacccactccagcccttgcctggagcctggcggacccagtgcatggcagagtcactgaaactgagtccggacgcaacacaggagagtctcagggacgtccaggctggaccacgcctcccccagactccacagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 791975 - DNA, 717 bp, Homo sapiens
  misc_feature: 41500.UNK.UNK.UNK.pb.heavy.1.raw 41500
ctatgcgccttgccagcccgctcagacagtatataggaagtagtccttgaccaggcagcccagggccgctgtgctctcggaggtgctcctggagcaggcgcgccagggggaagaccggatgggcccttggtggaggccgaaggagcgggtgaccagggttccctggccccaggcgtcgaaatgaaccgattttggaaacagatagtctcgcacaaaaatacacggcgcgtgtcctgagggctcaggctgttcatttgaagagacactgtgttccccggcattgtctctggagatgtgaatcgcgccctcaacggaatcacgcgtagacttgatttcctccatgaaatgacacactgcgccaccactccagcccctcgcctggagcctgccggaccactgcatattccaattatcgaagcgtgaatcagaggctgcacaggagagtctccagggacccccctactggggccacgcctcccccagactccacgaattgcaacctgacaccatgacacctcttaagaggcaacggaggaaaaccagctcagcccaaactcatggtggagtcctctgtgttcagtgatgatcacccgagtggaaacaccggcgacttccagtgctgggctcgtctcccagccccaaacccttcgatcgcgcgtctaaatcgagcaccggtcgtgtatatactgtctgatggcgcggagggaaggcgatacg

SEQ ID NO: 791976 - DNA, 672 bp, Homo sapiens
  misc_feature: 41574.44.55.E11.1.pb.heavy.1.raw 41574
cgtatcgcctccctcgcgccatcagacagtatatacacgaccggtgctcgatttagcactcgcacgttggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgttcagcagcaactacatgagttgggtccgccaggctccagggaaggggctggagtggtctcagtcatttatactggtgatttcacatactacgcagactccgtgaagggccgattcaccatctccagggacaattccaggaacacggtttatcttcaaatgaacaacctgagaggcgacgacacggccgtctattactgtgcggagacaagtcggcgctcggagtggttattattcgttttgacttctggggccagggaaccctggtcaccggtcgcctccgcctccaccaagggccccatcggtcttccccctggcaccctcctccaagagcacctctgggggcacagcggcctgggctgcctggtcaagggactacttccta

SEQ ID NO: 791977 - DNA, 687 bp, Homo sapiens
  misc_feature: 41649.44.73.G07.1.pb.heavy.1.raw 41649
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtcccctggccccagtgaaacgcccgataatagctgctggccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactcggcccttgcctggagccctggcggacccagtgcatgccagaactactgaaaactaaaatccagaggcttcacaggagagtctcagggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgccgagagcacagcggccctgagcgtagagctaaatcgagcaccggtcgtgtatatactgtctgatggcgcgagggaggcgatacg

SEQ ID NO: 791978 - DNA, 696 bp, Homo sapiens
  misc_feature: 41658.44.55.E11.1.pb.heavy.1.raw 41658
cgtatcgcctccctcgcgccatcagacagtatatacacgaccggtgctcgatttagcactcgcacgttgggtttggggagaggagccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcacgtcagcagcaactacatgagttgggtccgccaggctccagggaaggggctggagtgggtctcagtcatttatactggtgatttcacatactacgcagactccgtgaaggccgatcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggccatcggtcttcccctggcaccctcctccaagagcacctctgggggcacagcggccctgggctgcctggtcaaggactacttcctatatactgtctgagcgggctggcaaggcgcatag

SEQ ID NO: 791979 - DNA, 685 bp, Homo sapiens
  misc_feature: 41663.44.53.E09.1.pb.heavy.1.raw 41663
ctatgcgccttgccagcccgctcagaccagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccccagactccaccaactgcacctcacactggacaccttttaaaatagcagcaaggaaaatccagctcagcccaaactccatggtgagtcctctgtgttcagtcctgatcactgaatgaaaacacctgggaatccaaggctgggggctcctctccagagctcaacacactctctctaaatcgagcaccggtcgtgtatatactgtctgatggcgcgagggaggcgatacg

SEQ ID NO: 791980 - DNA, 718 bp, Homo sapiens
  misc_feature: 41666.44.85.H08.1.pb.heavy.1.raw 41666
ctatgcgccttgccagcccgctcagacagtatataggaagtagtccttgaccaggcagcccagggccgctgtgccccagaggtgctcttggaggagggtgccaggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctccccagactccaccagctgcacctgacactggacacctctaaaagagcaacgaggaaaacccagctcagcccaaactccatggtgagtcctctgtgttcagtgctgatcaccgaatggaaacaccgccgacttctagtgctgggctcctctcccagagctcccgcgactgagtgatactaaatcgagcaccggtcgtgtatatactgtctgatggcgcgagggaggcgatacg

SEQ ID NO: 791981 - DNA, 709 bp, Homo sapiens
  misc_feature: 41699.UNK.UNK.UNK.pb.heavy.1.raw 41699
cgtatcgcctccctcgcgccatcagacagtatatacacgaccgggtgctcgatttagtatcactcagtcgcggggagctctgggagaggagcccagcactagaagtcggcggtgtttccatcggtgatcagcactgaacacagagactcaccatggagttgggctgagctgggtttcctcgtgctctttaagaggtgtccagtgtcaggtgcagctggtggagtctgggggaggcgtggtccagcctgggaggtccctgagactctcctgtgcagcgtctggattcaccttcagtacctatggcatgcactgggtccgcaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgagacacggctgtgtattactgtgcgaggacatattgtagtactacacctgctgggactactactacggtatggacgtctgggccaaggaccacggtcaccgtctcctcagcctcacaagggcccatcggtcttcccctggcaccctcctccaagagcacctctgggggcacagcggccctgggctgcctggtcaaggacctacttcctatatactgtctgagcggctggcaaggcgcatag

SEQ ID NO: 791982 - DNA, 599 bp, Homo sapiens
  misc_feature: 41742.UNK.UNK.UNK.pb.heavy.1.raw 41742
ataggaagtagtccttgaccaggcagcccaggggccgctgtgcccccagaggtgctcctggagcagggcgccaggggggaagaccgatgggcccttgggtggaagctgaggaggacggtgaccgtgggtccctttgccccagacgtccagatggtaagacttataatacagaaaccagcctgtttcttttcccgcgcattacccgtgcacagtaatatgtgcctgtgtccgcagggtccatgttggtcatactaaagaccacctgccttttggaggtgtccttggagatggttaaactgctcttccagagatgtactgtaggatttttcgtcattcgagaagatgtgtgcaagccactccagggccttccctgggggggctgacggatcagctcacacccattctaatatcgttgagagagaacccaggagatggtgcaggtcaggcgtgttgggtcttctgtggggtttcacgcacggcagccgaccaggactccttcaagggtgacctgggacaagaccccaagagagatcgtgacgcagctagaatcgagcaccggtcgtgatagtatagactgatggcgcgagggaggcgatacg

SEQ ID NO: 791983 - DNA, 690 bp, Homo sapiens
  misc_feature: 41744.44.45.E01.1.pb.heavy.1.raw 41744
cgtatcgcctccctcgcgccatcagacagtatatacacgaccggtgctcgatttagtgagtcagtaaggggaaaggggctgggagaggagcccagcactagaagtcggcggtgtttccattcggtgatcagcactgaacacagaggactcaccatggagtttgggctgagctgggttttcctcgttgctctttaaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagttaaagaaatactatgggaaactccgtgaagggccgattctccgtctccagagacaattccaagaacaccgtgtatctacaaatgaacaatttgagagccgaggactcgggctctctattattgtacgagcccatcgttctactggggccagggagccctggtcaccgtgtctcctcagcctccaccaagggcccatcggtcttccccctggcgccctgctccaggagcacctccgagagcacagcggccctgggctgcctggtcaaggactacttcctatatactgtctgaggcgggctggcaaggcgcata

SEQ ID NO: 791984 - DNA, 660 bp, Homo sapiens
  misc_feature: 41769.UNK.UNK.UNK.pb.heavy.1.raw 41769
cgtatcgcctccctcgcgccatcagacagtatatacacgaccggtgctcgattagtaagtgtagattccgcgggggctttctgagagtcatggacctcctgtgcaagacatgagcacctgtggttcttcctcctgctggtggcggctcccagatggggtccagctgcagctgcagctgcaggagtcgggccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcgtcttccccctggcacctcctccaagagcacctctgggggcacagcggcctgggctgcctggtcaaggactacttcctatatactgtctgagcgggctggcaaggcgcatag

SEQ ID NO: 791985 - DNA, 677 bp, Homo sapiens
  misc_feature: 41775.44.53.E09.1.pb.heavy.1.raw 41775
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgtactgaaagtgaatccagaggctgcacaggagagtctagggactcccaggctttaccaaacctcccccagactccaccaactgcaccttcacactggacaccttttaaatagcagcaaggaaaatccagctcagcccaaactccatggtgagtcctctgtgttcagtcctgatcactgaatgaaaacacctgggaatccaaggctggggccctctcccagagctcaacacactctctctaaaatcgagcaccggtcgtgttatactgtctgatggcgcgagggaggcgatacg

SEQ ID NO: 791986 - DNA, 674 bp, Homo sapiens
  misc_feature: 41779.UNK.UNK.UNK.pb.heavy.1.raw 41779
ctatgcgccttgccagcccgctcagacagtatataggaagtagtccttgaccaggcagccagggccgctgtgctctcggaggtgctctggagcagggcgccagggggaagaccgatgggccttggtggaggctgaggaacggtgacagggttcctggccccagtagtcaagcgggaccgtctcgaggggctctcgcacaatatagacagccgtgtcctcacttgtgaggttgtacatttgcagatgcagtggtgttcctggaattgtctctggagacggtgaatcggcccttctcgagtctccgtagtgttctcaattcatctctgatatattgccacccactccagccccttgcctggagcctggcggacccagtgcatggcataggtcctgagatgatccagaggctgcacaggagagtctcagggagttcccaggctgggccgctcctccccagactccactagctgcacctgacactggccacctcttaaaagagcaacgaggaaacccatctcagcccaaaagtccatggtgagtcctcgtgtttcagtgatgatcaccgaatggaacaccggcgacttcagtgctgggctcgtccccccccctgagcgtagagctaatcgagcaccggtgtggtatatactgtctgatggcgcgagggaggcgatacg

SEQ ID NO: 791987 - DNA, 653 bp, Homo sapiens
  misc_feature: 41812.44.12.B01.1.pb.heavy.1.raw 41812
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctccagatggtcctgtccagctgcagctgcaggagtcgggccaggactggtgaagccttcggagaccctgtccctcacctgcactgtctctggtggctccatcagcagtagtagttactactggggctggatccgccagcccccagggaagggctggagtggattgggagtatctattatagtggagcacctactacaacccgtcctcaagagtcgagtcaccatatcagtagacacgtccaagaaccagttctcctgaagctgagctctgtgaccgcgcggacacggccgtgtattactgtgcgagagtagggcagttcgtcaccaactactttgaccactgggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 791988 - DNA, 668 bp, Homo sapiens
  misc_feature: 41850.44.53.E09.1.pb.heavy.1.raw 41850
cgtatcgcctccctcccccggcgccatcagacagtatatacacgaccggtgctcgatttagagagagtgtgtttgggtttgggggaagcacctgtggttcttcctccttgctggtggcggctcccagatgggtcctgtctcagccgcagctgcgggagtcggcccaggactggtgaaggccttcggagaccctgtccctcacgtgcaacggtctctggtgcctccatcgacagaagtaattttctactgggctggatccgccagcccccaggagaggggctgcagtggattggggagtctctattatagtgggaacacctactacaacccgtcccttcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctggggccaagggaccacggtcaccgttctcctcatcctcagcctccaccaagggcccatcggtcttcccccctggcgccctgctccaggagcacctccgagagcacagcggcccctggctgcctggtcaaggactacttcctatatactgtctgagcgggctggcaaggcgcaatag

SEQ ID NO: 791989 - DNA, 654 bp, Homo sapiens
  misc_feature: 41851.UNK.UNK.UNK.pb.heavy.1.raw 41851
ctatgcgccttgccagcccggctcagacagtatataggaagtagtccttgaccaggcaggcccagggccgctgtgctctcgaggtgctcctggagcagggcggccagggggaagaccgatgggcccttggtggaggcctgaggagacggtgaccagggttccctggcccgaatgaaaccatcccagacagtaatagacgctgtgtcctccgtgttcaggctgttcatctgcagagacaccgtatcttttgaatcatctcttgagatggtgaaatctgcctttcacgggtgcagcgtagtctgctgtcccaccgtccagctttggttctaatacgggccaaaccactccagcccccttccctggagcctggcggacccaggtcatccaggcggttactgaaagtgaatccagaggctgcacaggagagtctaagggactccccaggctttaccaaacctcccccagactccaccaactgcacctcacactggacaccttttaaaataggcagcaaggaaaatccagcctcagcccaaactcccatggtgagtcctctgtgttcagtcctgatcactgaatgaaaaacacctgggaatcccaaggctggggctcctctcccagagctcaacacactctctctaaatcgagcaccgg

SEQ ID NO: 791990 - DNA, 700 bp, Homo sapiens
  misc_feature: 41864.44.36.D03.1.pb.heavy.1.raw 41864
cgtatcgcctccctcgcgccatcagacagtatatacacgaccggtgctcgatttagctgcgtcacgatctctcttggggagctctgagagcggagccccagccccagaattccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaaccgaggacacgggcatgtattattgtgttgtgtttatatcaggaactgtccactgggccagggaaccctggtcaccgtctcctcagcctccaccaagggcccatcgtcttcccctggcgccctgctccaggagcacctccgagagcacagcggccctgggctgcctggtcaaggactacttcctatatactgtctgagcgggctggcaaggcgcatag

SEQ ID NO: 791991 - DNA, 713 bp, Homo sapiens
  misc_feature: 41867.UNK.UNK.UNK.pb.heavy.1.raw 41867
ctatgcgccttgcccagcccgctcagaccagtatataggaagtagtccttgaccaggcagcccagggccgctgtgctctcgaggtgctcctgggagcagggcgccagggggaagaaccgatgggcccttggtggaggctgaggagacggtgacccaggggttccctggccgaatgaaaccatcccagacagtaatagacggcctgtgtcctcggtgttcaggctgttcatctgcaagagacaaccgtatcttttgaacattctcttgagatgggtggaatctgcctttcaccgggtgcagcgtagtctgctgtccccagccgtcagctttggttctaatacgggccaacccactcagccccttccctggagcctggcggaccaggtcatccaggcgttactgaaaagtgaatccagaggctgcacaggagagtctaagggactccccaggctttaccaaacctcccccagactccaccaactggcaccctcacactggacaccttttaaaaatagcagcaaggaaaatccagctcaggccccaaactccatggtggagtcctctgtgttcagtcctgatcactgaatgaaaacacctgggaatccccaaggctggggctcctcttccagagctccccaaacccaaactactcacactaaatcgagcaaccggtcgtgtatatactgtcgatggcgcgggagggaggcgatacg

SEQ ID NO: 791992 - DNA, 625 bp, Homo sapiens
  misc_feature: 41872.44.38.D05.1.pb.heavy.1.raw 41872
cgtatcgcctccctcgcgccatcagacagtatatacacgaccggtgctcgatttagtatctgataggctgggttttccttgttgcctattttaaaaggtgtccagtgtgaggtgcagctggtggagtccgggggagggcttagttccagcctgggggtccctgagactctcctgtgcagcctctggattcaccttcagtagctactggatgcactgggtccgcccaagctccagggaaggggctggtgtgggtctcacgtattaatagtgatgggagtagcacaagctacgcggactccgtgaagggcgcgattcaccatctccagagacaacgccaagaacacgctgtatctgcaaatgaacagtctgagagccgaggacacggctgtgtattactgtgcaagaggccggtgcgggagttcggggagtttgcatactactactacggtatggacgtctggggccaagggaccacggtcaccgtctcctcagcttccaccaaggggccatcggtcttccccctggcgccctgctccaggagcacctctgggcacagcggccctgggctgcctggtcaaggactacttccctatatactgtctgagccggctggccaaggcgcata

SEQ ID NO: 791993 - DNA, 609 bp, Homo sapiens
  misc_feature: 41879.UNK.UNK.UNK.pb.heavy.1.raw 41879
ccgacaccttgctagggacttggagctaaggaacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaaacttaattgagatcctaggggatgggataggaaatagaatccacccctatcacccccccacatagcctgcttggggttgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 791994 - DNA, 705 bp, Homo sapiens
  misc_feature: 41890.44.62.F07.1.pb.heavy.1.raw 41890
cgtatcgcctccctcgcgccatcagacagtatatacacgaccggtgctcgattagtagtcgcataaaggaaaggggagctctgagagaggagcccagccctgggatttttcaggtgtcttcattgtgaccaggaccgaacagagagaagtctccatggagtttgggctgagctgcctttcttgggctttttaaagggtgtcgtgtgtgaagtgcagttgttggagtctggggggggctgattcggcctgggaggtccctgacctctcctgtgcgcctctggattcacctttagtgcctatggcatgacctggggtccgcgggctccagggagggggactggagttgggtctcaagtatcggagctgggtggtgtcactttctacggagactccgtgaagggccgcttcaccattccagggacaattccagacaatttgtttctccaatgaaaaacctgagacccgaggacaccaggcgtctattactgttttgaaagccaggaaccgacggtgtgaccccccatgacacctttagtacttgggccgggggacagtggtggaccgtctcttcagcctccaccaaggcccatcggtcttcccctgggcgccctgcctccaggagcacctccgagagcacagcggcctgggctgcctggtcaaggactacttcctatatactgtctgagcgggctggcaaggcgcatg

SEQ ID NO: 791995 - DNA, 722 bp, Homo sapiens
  misc_feature: 41931.UNK.UNK.UNK.pb.heavy.1.raw 41931
ctatgcgccttgccagcccgctcagacagtatataggaagtagtccttgaccaggcagcccaggccgctgtgcccccagaggtgctcttggaggagggtgccagggggaagaccgatgggcccttggtggaggctgaggagacggcgaccgtggtcccttggccccaggcgtccatacattggagtagagcatgtcatatctgtatccacgagccccatctctcgcacagtagtagacagccgtgtcctcgctccaggctattcatttccagatatatgtggttcttcgaattgtctctggagatggtgaatcggcccttcacggaatctacataatatttattacttccatcatacatataagtgccaccactccagtcccttgcctggagcctggcgggaccagtgcatgccatgtctgttgaaggtgatccaggacgctacacaggagagtctcagggacctccaggctggaccacgcctccccagactccaccagcttcacctgacactggacacctcttaaaagagcaacgaggaaaaacccaggtcagcccaaaactccatggtgagtcctctgtgttcggtgctgatcaccgactggaaacaccgccgacttctggtgctgggctcctctccagagctccccaaacccaacgaggctcactctaatcgagcaccggtcgtgtatatactgtctgatggcgcgaggaggcgatacg

SEQ ID NO: 791996 - DNA, 679 bp, Homo sapiens
  misc_feature: 41940.UNK.UNK.UNK.pb.heavy.1.raw 41940
cgtatcgcctcctcgcggcgcatcagacagtatatacacgaccggtgcgtcccgatttagtgcctatagacttgggcttttggggatgctttctgagagtcaaggaccgcgtcctgtgcaagaacatgaagcacctgtggtttttcctcctgctggtggcagctcccagatgggtccctgtcccaggtgccagctgcaggagtcgggcccaggactggtgaggccttcgggaaccctgtctctcatctgcactgtctctggagtttccatcagttctgatcattcttggcggctggatcgccggcgccccaggaggggaatggagtcggattggtgacatccatctatacccgggcgcgacgtactactctcccgtccctcaagagtcgtctcaccatttcgagggacacgtcatgaaccgcttctccctgaactgacctccgcgtgaccgtcgcgcggacacggccgtttatttctgtgcgaggcgagactgcggtctttcaatctatgggggccgtggcaccctggtcactgtctcctcagcttccacaaggccatcggtcttcccctggccgccctgctcaggagccacctctggggggggcggcacagcggcctggcgcctggtcaaggactacttgcctatatactgtctgagcggggctggcaaggcgcatag

SEQ ID NO: 791997 - DNA, 723 bp, Homo sapiens
  misc_feature: 41949.UNK.UNK.UNK.pb.heavy.1.raw 41949
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtccgtgtatatactgtctgatggcgcgagggaggcgatacg

SEQ ID NO: 791998 - DNA, 719 bp, Homo sapiens
  misc_feature: 41974.UNK.UNK.UNK.pb.heavy.1.raw 41974
cgtatcgcctccctcgccgccatcagacagtatatacacgaccggtggctcgattagtagctctatcaggggggagcatcacataacaaccacattcctcctctaaagaagcccctgggagcacagctcatcaccatggactggaccctggaggttcctcctttgttggtggcagcagcaacaggtgccagtccctggtgcaactggtgcagtctgggactagaatgccgccaaccttggtcctcgggtgaccctttcctgcacggcctctggaagtactaccagttccactacttataccatcaactgggtgcgcccaggccccctggacaagggcttgagtggatgggtggaatcatccctctttttggctcactcacctacggcacgagacttccggggcagaattacgattaccgcggacaaagtccacagacacagtctccattgacaatgagttcttttgaaatccgacgacacgggccgtcttaactactgtgcgagaggtccggtacccccagctcgcctgggagcctttgagatctgggggccagggaaccctggtcattgtcaacctcagcttccaccaagggcccatcggtcttccccctggcgcccctgctcccaggaagcacctctgggggcacagcggccctgggctgcctggtcaaggactacttcctaatatactggtctgagcgggctggcaaggcgcaaag

SEQ ID NO: 791999 - DNA, 664 bp, Homo sapiens
  misc_feature: 42027.UNK.UNK.UNK.pb.heavy.1.raw 42027
cgtatcgcctccctcgcgccatcagacagtatatacacgaccggtgctcgatttagtggctatagacttgggtttggggaatgctttctgagagtcaagggacctcctgtgcaaagaacatgaagcacctgtggtttttcctcctgctggtgggcagcctcccagatgggtcctgtcccaggtgcagctgcaggagtcgggcccaggaactggtgaggccttcgggaaccctgtctctcatctgcactgtctctggagtttccatcagttctgatcattcttggggctggatccggcagcccccagggaaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaaatctatgggccgtggcaccctggtcactgtctcctcagcttccaccaagggcccatcggtcttccccctggcgccctgctccaggagcacctctgggggccacagcggccctggctgcctggtcaaggaactacttcctatatactgtctgagcggctggcaaggcggcatag

SEQ ID NO: 792000 - DNA, 659 bp, Homo sapiens
  misc_feature: 42193.UNK.UNK.UNK.pb.heavy.1.raw 42193
ctatgcgccttgccagcccgctcagacagtatataggaaagtgtccttgaccaggcagcccagggccgctgtgctctcggaggtgccctggagcagggcgccaggggaagacgatgggcccttggtggagggctgatgagaccggtgacctggatttccctggccccagggttcgaagaagcccgtggtcattgtggtcatgaatgggcaaagaaaaatatgtgcctgtgtccacaagggtccacgtggtcaatgtaaggacccacctggttttttggacgtgtccttcgtgagcgtgagtctggtcgtcagagaaggaactatatcgtatatcgcattccaataagtgggtgcgatccactccaggcctttccggggggctgccgcacccagacacgcccctctccaggagtgacgagtgagaagcctgagacggtgcaggttcgccggagggtctggtgtgggtttcaccaatgtagggccagactcttttcacggtgatctgggaacaggccccatgaaaagggatgcgtcagcagccaggagcgtggagccaaagtgtgtccatggtggggcaacaggagtccccttactgacctcacttaaatcgagcaccggtcgtgtatatactgtctgatggccgcgagggaggcgatacg

SEQ ID NO: 792001 - DNA, 705 bp, Homo sapiens
  misc_feature: 42202.44.36.D03.1.pb.heavy.1.raw 42202
cgtatcgcctccctcgcgccatcagacagtatatacacgaccggtgctcgatttagctgcgtcacgatctctcttggggagctctgagagcggagccccagcccagaattcccaggtgtttcatttggtgatcagcactgaacacagaggactcaccatggagttcgggctgagctgggttttccttgttgttattttacaaggtgtccagagtgaagtgcagttggtggagtccgggggagacttggtccagcctggaggggtccctgagactctcctgtgttcgccttctggattcaccatcagtgaccactatatggactgggtccgccaggctccagggaagggctggagtggcttggccgcagtaaaaacaaagttgccagctttatcacagagtacgccgcgtctgtgaaagccagattcacccctctcaagaagatggacttcaagaactcattgatctgcgaatgactaacctgaaaaccgaggacacgggcatgtattattgtggttgtgtttatatcaggaactgtccactggggccagggaaccctggtcaccgtctcctcagcctccaccaaggggccatcggtcttcccctgacgccctgctccaggagcacctcgagagcacagcggcctgggctgcctggtcaaggactacttcctatatactgtctgagcgggctggcaaggcgcatag

SEQ ID NO: 792002 - DNA, 594 bp, Homo sapiens
  misc_feature: 42223.UNK.UNK.UNK.pb.heavy.1.raw 42223
gaaggctggcaggctatgcaccctggtccaggtcaaaagctgcggaacccgctagcggccatttggccataggggtccgcagattcatattgtcgtctagcatgcacaatgctgcaaaccagcttgcaatgcccacagcaagcggccatctttacgccacgttgaattgtttattacctgtgactggctatggcttgcaacgccactcgtaaaactagtactttgcggttaggggaagtagacaaaccattactccacttcccggaagttcaactcattcaacacgaaataaaagtaactcaacacccaagcaggctatgtggggggtgatagggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 792003 - DNA, 709 bp, Homo sapiens
  misc_feature: 42224.44.36.D03.1.pb.heavy.1.raw 42224
ctatgcgccttgccagcccgctcagacagtatataggaaagtagtccttgaccaggcagcccagggccgctgtgctctcggaggtgctcctggagcagggcgccagggggaagaccgatggcccttggtggaggctgaggagacggtgaccagggttccccggcccagtagtcaaaaccagccactgaccaagtggcccgatctctcgaacagaagtagacagccgtgtcctcgtctctcaggctgttcatttccagatacagtgagttcttggcattgtccctggaattggtgaatcggccttcacagagtctgcgtagtaggtggtatctccagcaatattaacatatgaaacccactccagccccttccctgggagcctggcggaaccagttcatggcatagtcactgaagatgaatccagaggctgcacaggagagtctcagggacccccccgctgtaccaagcctccccagactccaccagccgcacctcacagtggacaccttctaaaatagcaacaaggaaaacccagcgcagccccaactccatggtgagtcctctgtgttcagtgctgatcaccaagtggaaatgccttggaatccagggctaaggcactctctgagagctcccaagggagatcgtgacgcagctaaatcgagcaccggtcgtgtatatactgtctgatggcgcgaagggaggcgatacg

SEQ ID NO: 792004 - DNA, 603 bp, Homo sapiens
  misc_feature: 42235.UNK.UNK.UNK.pb.heavy.1.raw 42235
ccgacacgctgctagggacttggagctaaggacgacatattgcctttagacagtcgaaggtgacgccttagctaccactgaacgtttaggcgccagatgcggtctgggatgactaactcgcagcttatcgatgatctactgcacgctcaaccaaccaggtcttgatgcgcgcgataggactgacggatcgctacagacatttaactcgctagtaacttattgagatcctaggggatggggataggaaatgaatccacccctatcaccccccccacatagcctgcttgggtgttgagtttactttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagatggccgcttgctgtgggcattgcaagctgggtttgcagcattgtgcatgctagacgacaatatgaatctgcgggacccctagtggccaagatggccgctagcgggttcgcagctttttgacctggaccagggtgcatagcctgcccagccttc

SEQ ID NO: 792005 - DNA, 607 bp, Homo sapiens
  misc_feature: 42268.44.23.C01.1.pb.heavy.1.raw 42268
ctatgcgccttgccagcccgctcagacagtatataggaagtagtccttgaccaggcagccaggcgctgtgcccccagaggtgctcctggagcagggcgcagggggaagaccgatgggcccttggtggaagctgaggagacagtgaccagggtgccacggccccatagattgaaagaccagtctcgcctcgcacagaataaacggccgtgtccgcggcggtcacgaggtcagtttcagggagaagcggttcatggacgtgtcctcgaaatggtgagacgactcttgagggacggagagtagtacgtcgccccagtataatggatgtcaccaatccactccattccctcctgggggctgccggatccagcccaagaatgatcagaactgatggaaactccaggacagtgcagatgagagacagggttcccgaaggcctcaccagtcctggcccgactcctgcagctgcacctgggacaggcacccatctgggagctgccaccagcaggagaaaaacacaggtgttcaccctgccccaatccctaatcacgtgtactaaatcgagcaccggtcgtgtatatactgtctgatggcgcgaggaggcgatacg

SEQ ID NO: 792006 - DNA, 665 bp, Homo sapiens
  misc_feature: 42272.UNK.UNK.UNK.pb.heavy.1.raw 42272
cgtatcgcctcctcgcgccatcagacagtatatacacgaccggtgctcgatttgagagagtgtgttgagctctgggagaggagccccagccttgggattcccaggtgttttcattcagtgatcaggactgaacacagagggactcaccatggagtttgggctgagctggattttccttgctgctattttaaaaggtgtccagtgtgaggtgcagttggtggagtctggggaggttgggtaaagcctgggagtcccttagactctcctgtgcagcctctggattcactttcagtacgcctggatgacctgggtccgccaggctccagggaggggctggagtggttggcgtattagaaccaaagcctgacggtggacgcagactacgctgcacccgtgaaaggcagattcaccatctcaagaatgatcaaagatacggtgtcctctgcagatgaacagcctgaacaccgaggacacagccgtctattactgtctggatggtttcattcgggccagggaaccctgtcaccgtctcctcagcctccacagggcccatcggtcttcccctggcgcctgctccaggagcacctccgagagcacagcgccctggctgcctggtcaaggactacttcctatatactgtctgagcgggctggcaaggcgcatag

SEQ ID NO: 792007 - DNA, 677 bp, Homo sapiens
  misc_feature: 42294.44.53.E09.1.pb.heavy.1.raw 42294
cgtatcgcctccctccgcgccatcagacagtatatacacgaccggtgctcgatttagagagagtgtgttgagctctgggagaggagccccagccttgggattccaggtgttttcattcagtgatcaggactgaacacagaggactcaccatggagtttgggctgagctggatttccttgctgctatttaaaaggtgtccagtgtgaggtgcagttggtggagtctggggaggtttggtaaagcctggggagtcccttagactctcctgtgcagcctctggattcactttcagtaacgcctggatgacctggtccgccaggctccagggaaggggctggagtgggttggccgtattagaaccaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccaggaaccctggtcaccgtctcctcagcctccaccaagggcccatcggtcttccccctggcgccctggctccaggagcacctccgagagcacagcggccctgggctgcctggtcaaggactacttcctatatactgtctgagcgggctggcaaggcgcata

SEQ ID NO: 792008 - DNA, 727 bp, Homo sapiens
  misc_feature: 42306.44.85.H08.1.pb.heavy.1.raw 42306
ctatgcgccttgccagcccgctcagacagtatataggaagtagtccttgaccaggcagccaggccgctgtgcccccagaggctgctcttggaggagggtgccaggggaagaccgatgggcccttggggaggctgaggagacggtgaccgtggtccttggccccagacgtccataccgtagtagtagtcccagcaggtggtagtactacaatatgtcctcgcacagtaatacacagccgtgtcctcgctctcaggctgttcatttgcagatacagcgtgttcttggaattgtctctggagatggtgaatcggcccttcacggagtctgcatagtatttattacttccatcatcatacatataagtgccacgccactccagccccttgcctggagcctggcggacccagtgcatgccataggtactctgaagcgtgaatccagacgctgcacaggagagtctcagggacctcccaggctggaccacgcctcccccagactccaccaggctgcacctgacactggacacctcttaaaagagcaacgaggaaaacccagctcagcccaaactccatggtgagtcctctgtgttcagtgctgatcacccgaatggaaacaccgccgacttctagtgctgggctcctcacccagagctccccgcgactgagtgatactaaatcgagcaccggtcgtgcgtatatactgtctgatgcgcgagggaggcgatacg

SEQ ID NO: 792009 - DNA, 665 bp, Homo sapiens
  misc_feature: 42335.44.23.C01.1.pb.heavy.1.raw 42335
ctatgcgccttgccagcccgctcagacagtatataggaagtagtccttgaccaggcagcccagggggccgcggctggcccagaggtgctcctgagcagggcgccagggggaagacccgatggcccttggtggaagctgaggagacagtgaccagggtgccacggcccccatagattgaaagaccagtctcgcctcgcacagaaataaacggccgtgtccgcggcggtcacggaggtccagtttcagggagaagcggttcatggaccgtgtccctcgaaatggtgagacgactcttgagggacggagagtagtacggtcgccccagtataatggatgtcaccaatccactccatttccctcccttgggggctgccggatccagccccaaagaaatgatcagaactgatggaaactccagagacagtgcagatgagagaacagggttcccgaaggcctcaccagtcctgggcccgactcctgcagctgcacctgggacaggacccatctggggagctgccaccagcaggaggaaaaaccacaggtgcttcatgttcttgcacaggaggcgtccttgactctcagaaaagcccccaatccctaatcacgtgtactaaatcgagcaccggtcgtgtatatactgtctgatggcgcgaggaggcgatacg

SEQ ID NO: 792010 - DNA, 608 bp, Homo sapiens
  misc_feature: 42343.44.36.D03.1.pb.heavy.1.raw 42343
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792011 - DNA, 608 bp, Homo sapiens
  misc_feature: 42393.UNK.UNK.UNK.pb.heavy.1.raw 42393
cccacaccgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgccaaagtactagttttacgagtggcgttgcaagccatagccagtcacaggtaataaacaattcaacgtggcgtaaagattggccgcttgctgtgggcattgcaagctggtttgcagcattgtgcatgctagacgacaatatgaatctgcgggacccctagtggccaagatggccgctagcgggttccgcagcttttgacctggaccagggtgcatagcctgcccagccttc

SEQ ID NO: 792012 - DNA, 604 bp, Homo sapiens
  misc_feature: 42423.UNK.UNK.UNK.pb.heavy.1.raw 42423
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttccggaagttcaactcattccaacacgaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792013 - DNA, 697 bp, Homo sapiens
  misc_feature: 42454.44.55.E11.1.pb.heavy.1.raw 42454
ctatgcgccttgccagcccgctcagacagtatataggaagtagtccttgaccaggcagcccaggccgctgtgccccagaggtgctcttggaggaggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactcagcccttccctggagcctggcggacccaactcatgtagttgctgctgacggtgagcccagaggctgcacaggagagtctctggaacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaacccaacgtgcgagtgctaatcgagcaccggtcgtgtatatactgtctgatggcgcgagggaggcgatacg

SEQ ID NO: 792014 - DNA, 702 bp, Homo sapiens
  misc_feature: 42456.UNK.UNK.UNK.pb.heavy.1.raw 42456
cgtatcgcctccctcgcgccatcagacagtatatacacgaccgtgctcgatttagtgtagtgtgagggaaaggggtctggagaggagccagcactagaagtcggcggtgtttccattcggtgatcagcactgaacacagaggactcaccatggaagttgggctgagctgggttttcctcgttgctcttttaagaggtgtccactgtcaggtgcacctggtggagtctgggaggcgtggtccagcctgggaggtccctgagactcttcctgtgaagcctctggatttagtttcagtggttctggcatgcactggtccgccaggctccaggcaagggccggagtggttggcagttatagcacatgatggaagttctgaatattatgcagactccgtgaagggccgattcaccatctccagagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttcccctggcgcccctgctccaggagcacctcgagagccacagcggccctgggctgcctggtcaaggactacttcctatatactgtctgagcgggctggcaggcgcatag

SEQ ID NO: 792015 - DNA, 706 bp, Homo sapiens
  misc_feature: 42468.44.73.G07.1.pb.heavy.1.raw 42468
ctatgcgccttgccagcccgctcagacagtatataggaagtagtccttgaccaggcagcccagggccgctgtggctctcggaggtgctcctggaagcagggcgccaggggggaagaccgatggggcccttggtggaggctgaggagacggtgaccagtgtcccctggccccagtgaaacgcccgataatagctgctgccacttcccgatctcgcacagtaataccagagccgagtcctcgcctctcaggctgatcattttccaggtacagagtgttccgggaattgtctcctggagatggtgaatcggccccttcacggagtctgcataatatctagaagttccatcatatgctataactgccaaccactccggccccttgcctggagcctggcggacccagtgcatgccagaaaactactgaaaactaaatccagaggctttcacaggagaagtctcagggacctcccaggctggaccacgccctcccccagactccaccaggtgcacctgaccactgggacacctcttaaaagagtaacgagggaaaaaacccagctcagcccaaacctccatggtgagtcctctggtgttcagtgctgatcaccgaatggaaacaccgccgagagcacagcggccctgagcgtagagctaaatcgagcaccggtcgtgtatatactgtctgatggcgcgagggaggcgatacg

SEQ ID NO: 792016 - DNA, 691 bp, Homo sapiens
  misc_feature: 42508.44.56.F01.1.pb.heavy.1.raw 42508
cgtatcgcctccctcgcgcatcaagacagtatatacacgaccggtgctcgattagcagacgtctgaacacacaaagggctgggagaggagcccagccgtgagattcccaggagtttccacttggtgatcagcactgagcacagaccaccaaccatggagtttgggctaatcttgattttcctgtagttttttagaagtgtcagtgcgaggcgactggcgagtcgggggggggcttggcacagccagggcggtctctgagactctcctgtgtagtctcaggattcagtctagtgattatcacttggcctgggtccgtcaggctccagggaagggcttgagtggatcactttcgtcagaatgaaactttatggtggaagtaaagaagtacgccgcgtctgtgaagggaagattcaccggtctcaaagggatgactccaacagtgttggccatttacaaaatgagcaacctgagacccgacgacacaggcgtcctattactggcgccaggcgatcctgggacgtcgatgcatttgatatttggggccagggacaatggtcaccgtctcttcagcttcaccaagggcccatcggtcttccccctggcgccctgctccaggagcacctctgggggcacagcggcctggctgcctggtcaaggactacttcctatatactgtctgagcgggctggca

SEQ ID NO: 792017 - DNA, 605 bp, Homo sapiens
  misc_feature: 42512.UNK.UNK.UNK.pb.heavy.1.raw 42512
cgtattcgcccctcgcgctcaagtatatacggtgccgttagcgtcacgatctctcttggggagagcgggccagccccgattccaggttttcattggtgatgcctgaacacagaggactcaccatgggttcggctgagcgggttttcctgttgttattttacaaggtgtccagtgaagtgcagtttggggagtcgggggagacttgtccagcctggaggtctgaacttctggttcgcctctgattcacatcatgaccacaatggacggtcggctccgcaggaaggggggctgagtggctggccgcagtaaacacaaagttgccgcttatcagagtcgcgcgtctgtgaagccagattcaccttcaagagatgcttcaagaactcattgattctgcgaatgactaacctgaaaccgaggcacggggcatgatttgtggttttatcaggaactgtccactggggccgggaccctggtcacgtctcctcagcctccaccaagggccatcgttcttccctggcgccctgcccaggccccgagagcacagcggcctggctgcctgtcaaggactatcctatatacctgtctgagcgggctgcaggcgctag

SEQ ID NO: 792018 - DNA, 654 bp, Homo sapiens
  misc_feature: 42562.44.86.H09.1.pb.heavy.1.raw 42562
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792019 - DNA, 709 bp, Homo sapiens
  misc_feature: 42565.UNK.UNK.UNK.pb.heavy.1.raw 42565
ctatgcgccttgccagcccgctcagacagtatataggaagtagtccttgaccaggcagcccagggccgctgtgctctcggaggtgctcctggagcagggcgcgcagggggaagaccgatgggccccttggtggaggctgaagagacggtcaccactgtcccccggccccaagtactaaaggtgtcatgggggggtcaccgtggtcctggctttcaaacagtaatagacgcctgtgtcctcggtctcaggtttttcatttggagaaacaatttgtcctcgcgaattgtccctgggaaatggtgaagcggcccttcacggagtctccgtagaaagtgacaccaccagctccgatactgagaccccactccagtcccctccctggagcccggcggaccaggtcatgccataggcactaaaggtgaatccagaggccgcacaggagagggtcagggacctccaggccgaatcaggccccccagactccaacaactgcacttcacacacgacaccctttaaaaaagccacaagaaaaaggcagctcagcccaaactccatggagacttctctctgttcggtccggtcaccaatgaagacacctgaaaatcccaggctgggctcctctctcagagctcccctttccctttatgcgactactaaatcgagcaccgtcgtgtatattactgtctgatggcgcgagggaggcgatacg

SEQ ID NO: 792020 - DNA, 696 bp, Homo sapiens
  misc_feature: 42577.UNK.UNK.UNK.pb.heavy.1.raw 42577
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcgtttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagccctggcggacccagtccatatagtggtcactgatggtgaatccagaggcgacacaggagagtctcagggaccctccaggctggaccaagtctccccggactccaccaactgcacttcactctggacaccttgtaaataacacaaggaaaacccagctcagcccgaactccatggtgagtcctctgtgttcagtgctgatcaccaaatgaaacacctggaattctggggctggggctccgctctcagagctccccaagagagatcgtgacgcagctaaatcagcaccggtcgtgtatatactgtctgatggcgcgaggaggcgatac

SEQ ID NO: 792021 - DNA, 719 bp, Homo sapiens
  misc_feature: 42580.44.33.C11.1.pb.heavy.1.raw 42580
cgtatcgcctccctcgcgccatcagacagtatatacacgaccggtgctcgatttagagtgagctcgttgggttggggctgggagaggagcccagcaccagaagtcggcggtgtttccagtcggtgatcagcaccgaacacagaggactccaccatggagtttggctgacctgggtttttcctcgttgctcttttaagaggtgtccagtgtcaggtgaagctggtggagtctggggaggcgtggtccagcctggaggtccctgagactctcctgtgtagcgtctggattcacctttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatgggctcgtggatacagatatgacatgctctactccaatggtatggacgcctgggccaagggaccacggtcgccgtctcctcagcctccacaaggcccatcggtcttcccctggcaccctcctccaagagcacctctgggggcacagcggccctgggctgcctggtcaaggactacttcctatatactgtctgagcgggctggcaaggcgcatag

SEQ ID NO: 792022 - DNA, 696 bp, Homo sapiens
  misc_feature: 42581.44.36.D03.1.pb.heavy.1.raw 42581
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaagggctggagtggcttggccgcagtaaaacaaagttgccagcttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgcctgctccaggagcacctccgagagcacagcggccctgggctgcctggtcaagactacttcctatatactgtctgagcgggctggcaaggcgcatag

SEQ ID NO: 792023 - DNA, 690 bp, Homo sapiens
  misc_feature: 42617.UNK.UNK.UNK.pb.heavy.1.raw 42617
cgtatcgcctccctcgcgccatcagacagtatatacacgaccgtgctcgatttgatcacataacaccacactcctcctctaaagaagcccctgggagccacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgcttttatttgggtgcgacaggccctggacaaggacttgagtggctgggagggatcatccctatctttggtgcatcgaattacgcacagaagtttcaggacagagtcaccattaccgcggacgaatccacgagtacagcctacatggagctgagcaggcctgagatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttccccctggcgccctgctccaggagcacctctgggggcacagcggccctggctgcctggtcaaggactacttcctatatactggtcgagcgggctggcaaggcgcatag

SEQ ID NO: 792024 - DNA, 700 bp, Homo sapiens
  misc_feature: 42621.44.55.E11.1.pb.heavy.1.raw 42621
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 792025 - DNA, 656 bp, Homo sapiens
  misc_feature: 42623.44.12.B01.1.pb.heavy.1.raw 42623
ctatgcgccttgccagcccgctcagacagtatataggaagtagtccttgacaggcagccagggccgctgtgccccagaggtgctcttggaggagggtgccaggggaagaccgatggcccttggtggaggctgaggagacggtgaccaggttccctggccccagtggtcaaagtagttggtgacgaactgccctactctcgcacagtaatacacggccgtgtccgcggcggtcacagagctcagcttcaggagaaactggttcttggacgtgtctactgatatggtgactcgactcttgagggacgggttgtagtaggtgctcccactataatagatactcccaatccactccagcccttccctgggggctggcggatccagccccagtagtaactactactgctgatggagccaccagagacagtgcaggtgagggacagggtctccgaaggcttcacagtcctgggccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 792026 - DNA, 679 bp, Homo sapiens
  misc_feature: 42669.44.53.E09.1.pb.heavy.1.raw 42669
ctatgcgccttgccagcccgctcagacagttataggaagtagtccttgaccaggcagcccagggcgctggctctcggaggtgctcctggagcagggcgccagggggaagaccgatgggcccttggtggaggctgaggagacggtgaccagggttccctggccgaatgaaaccatcccagacagtaatagacggctgtgtcctcggtgttcagtgctgttcatctgcagagacaccgtatcttttgaatcatctcttgagatggtgaatctgcctttcacgggtgcagcgtagtctgctgtcccaccgtcagctttggttctaatacggccaacccactccagcccctccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctgggatcccaaggctggggctcctctcccagagctcaacacactctctctaaatcgagcaccggtcgtgtaatatactgtctgatggcgcgagggaggcgatacg

SEQ ID NO: 792027 - DNA, 663 bp, Homo sapiens
  misc_feature: 42713.44.12.B01.1.pb.heavy.1.raw 42713
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactgggccagggaaccctggtcaccgtctcctcagcctccaccaaggggcccatcggtcttcccctggcaccctcctccaagagcacctctgggggcacagcggccctgggctgcctggtcaaggactacttcctatatactgtctgagcgggctggcaaggcgcatag

SEQ ID NO: 792028 - DNA, 650 bp, Homo sapiens
  misc_feature: 42726.44.57.F02.1.pb.heavy.1.raw 42726
ctatgcgccttgccagcccgctcagacagtatataggaagtagtccttgaccaggcagccccagggccgctgtgcccccagaggtgctcctggagcaggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgagggacggagagtagtacgtcgccccagtataatggatgtcaccaatccactccattccctccctgggggctgccggatccagccccaagaatgatcagaactgatggaaactccagagacagtgcagatgagagacaggttcccgaaggcctcaccagtcctgggcccgactcctgcagctgcacctgggacaggacccatctgggagcctgccaccagcaggaggaaaaacacaggtgcttcatgttcttgcacaggaggtccttgactctcagaaagcatcccaaacccaactatatcgagctaaatcgagcaccggtcgtgtatatactgtctgatggcgcgagggaggcgatacg

SEQ ID NO: 792029 - DNA, 681 bp, Homo sapiens
  misc_feature: 42728.44.73.G07.1.pb.heavy.1.raw 42728
ctatgcgccttgccagcccgctcagacagtatataggaagtagtccttgaccaggcagcccagggccgctgtgctctcgaggtgctcctggagcagggcgccaggggaagaccgatgggcccttggtggaggctgaggagacggtgccagggttcctggccccagtagtcaagcggggacgtctcgagggggctctcgcacaataatagacagccgtgtcctcactgtgaggttgtacatttgcagatgcagtgtgttcctggaattgtctctggagacggtgaatcgccccttctcggagtctccgtagtgttcttcaatccatcttctgatatattgccacccactcagccccttgcctggagcctggcggacccagtgcatggcataggtcctgaagatgaatccagaggcctgcacaggagagtctcagggagttcccagactgggccgctcctccccagaactccactagctgcacctgacactggccacctcttaaaagagcacgaggaaaacccatctcagccaaagtccatggtgagtcctctgtgttcagtgatgatcaccgaatggaaacaccggcgacttccagtgctgggctcgtctcccccctgagcgtagagctaatcgagcaccggtcgtgtatatactgtctgatggcgcgagggaggcgatacg

SEQ ID NO: 792030 - DNA, 669 bp, Homo sapiens
  misc_feature: 42757.44.6.A06.1.pb.heavy.1.raw 42757
cgtatcgcctccctcgcgccatcagacagtatatacacgaccggtgctcgatttagatctactgacaaccacattcctcctctaaagaagcccctgggagcacagctcatcaccatggactggacctggaggttcctcttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttcaccaagggcccatcggtcttcccctggcgccctgctccaggagcactctgggggcacagcggccctgggctgcctggtcaaggactacttcctatatactgtctgagcggctggcaaggcgcatag

SEQ ID NO: 792031 - DNA, 652 bp, Homo sapiens
  misc_feature: 42827.44.86.H09.1.pb.heavy.1.raw 42827
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggtcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggccccgactcctgcagctgcacctgggacaggacccatctgggagctgccaccagcaggaggaaaaaccacaggtgcttcatgttcttgccacaggaggtccttgactctcagaaagcatccccaaacccaagtctatagcactaatcgagcaccggtcgtgtatatactgtctgatggcgcgagggaggcgatacg

SEQ ID NO: 792032 - DNA, 704 bp, Homo sapiens
  misc_feature: 42893.UNK.UNK.UNK.pb.heavy.1.raw 42893
ctatgcgccttgccagcccgctcagacagtatataggaagtagtccttgaccaggcagccccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaagtccaacaaggagaacccagctcagcaaaacttccatggtgagtcctctgtgtttcagtgctgatcaccgaatggaaacacctcggaatcccagtgctgggctcctctcccccccaaacccaacgtgcgagtgctaaatcggcaccggtcgtgtatatactgtctgatggcgcgagggaggcgatacg

SEQ ID NO: 792033 - DNA, 659 bp, Homo sapiens
  misc_feature: 42916.UNK.UNK.UNK.pb.heavy.1.raw 42916
cgtatcgcctccctcgcgccatcagacagtatatacacgacggtgctcgatttagtagtgtagatttccgcggggctttctgagagtcatggacctcctgtgcaagaacatgaagcacctgtggttcttcctcctgctggtggcggctcccagatgggtcctgtccagctgcagctgcaggagtcgggcccaggactggtgaagccttcggagaccctgtccctcacctgcactgtctctggtggctccatcagcagttagtagttactactggggctggatccgccagcccccagggaaggggctggagtggattgggagtatctattatagtgggagcacctactacaacccgtctcaagagtcgagtcaccatatcagtagacacgtccaagaaccagttctccctgaagctgagctctgtgaccgccgcggacacggccgtgtattactgtgcgagagtagggcagttcgtcaccaactactttgacactgggccagggaaccctggtcaccgtctcctcagcctccaccaggggcccatcggtcttccccctggcaccctcctccaagagcacctctggggcacagcggccctgggctgcctggtcaaggactactttcctatatactgtctgagcgggctggcaaggcgcata

SEQ ID NO: 792034 - DNA, 588 bp, Homo sapiens
  misc_feature: 42938.UNK.UNK.UNK.pb.heavy.1.raw 42938
gaaggctggcaggctatgcaccctggtccaggtcaaaagctgcggaacccgctagcggccatcttggccactagggtcccgcagattcatattgtcgtctagcatgcacaatgctgcaaacccagctgcaatgcccacagcaagcgccaatctttacgccacgttgaattgtttattacctgtgactggctatggcttgcaacgccactcgtaaaactagtacttgcggttagggaagtagacaaacccattactccacttccgaagttcaactcattccaacacaaataaaagtaaactcaacacccaagcaggctatgtgggggtgataggggtgattctatttcctatcccatccctaggatctcattaagttactagcgagttaaatgtctgtagcgatcccgtcagtcctatcgcgcgcatcaagacctggttggttgagcgtgcagtagatcatcgataagctgcgagttaggtcatccagacgcatctggcgcctaacgttcagtggtagctaaggcgtcaccttcgactgtctaaagcaatatgtcgtccttagctccaagtccctagcaagcgtgtcgg

SEQ ID NO: 792035 - DNA, 697 bp, Homo sapiens
  misc_feature: 42953.44.55.E11.1.pb.heavy.1.raw 42953
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaagggctggagtgggtctcagtcatttatactggtgatttcactactacgcagactccgtgaagggccgattcaccatctccaggacaattccaggaacacggtttatcttcaaatgaacaacctgagaggcgacgacacggccgtctattactgtgcgagacaagtcggcgctcggagtggttattattcgttgacttctggggccagggaaccctggtcaccgtcgcctccgcctccaccaagggccatcggtcttccccctggcaccctcctccaagagcacctctgggggcacagcggccctgggctgcctggtcaagactacttcctatatactgtctgagcggctggcaaggcgcataa

SEQ ID NO: 792036 - DNA, 696 bp, Homo sapiens
  misc_feature: 43076.UNK.UNK.UNK.pb.heavy.1.raw 43076
cgtatcgcctccctcgcgccatcagacagtatatacacgaccgtgctcgatttagctgcgtcacgatctctctgggagctctgaggcggagccccagccccagaattcccaggtgttttcatttggtgatcagcaactgaacacagaggactcaccatggagttcgggctgagctgggttttccttgttgttattttacaagggtcccggagtgagtgcagtggggagtccggggagacttgtcccagcctggagggtcgctgagactctccttgtcggcctctggatcacatcagtgaccaccatatggactggtccgccaggctcaggaaggggtggagtggctggccgcagtaaaaccaaagttgccagctttatcacaggagtacgccggcgtctggaaagccagattcaccctctcagagatgacttcagaactcattgattctgcgaaatgactaacctgaaaaccgaggcacacgggcatgtattattgtgttgtgtttatatcaggaactgtccactggggccaggggaacccctggtcaccgtctctcagcctccaccaagggcccatcggtcttccccctggcgccctgctccaggagcacctccgagagcaccagcggccctgggtgcctggtcaggactacttccatatacggccgtctgagcggggctggcaaggcgcattag

SEQ ID NO: 792037 - DNA, 644 bp, Homo sapiens
  misc_feature: 43142.44.57.F02.1.pb.heavy.1.raw 43142
cgtatcgcctccctcgcgccatcagacagtatatacacgaccggtgctcgatttagctcgatatagttgggtttgggatgctttctgagagtcaaggacctcctgtgcaagaacatgaagcactgtggtttttcctcctgctggtggcagctccagatggtcctgtcccaggtgcagctgcaggagtcggcccaggactggtgaggccttcgggaacctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaaggcccatcggtcttccccctggcgccctgctccaggagcacctctggggcacagcggccctggctgcctggtcaaggactacttcctatatactgtctgagcgggctggcaaggcgcatag

SEQ ID NO: 792038 - DNA, 595 bp, Homo sapiens
  misc_feature: 43195.44.36.D03.1.pb.heavy.1.raw 43195
ctatgcgccttgccagcccgctcagacagtatataggaagtagtccttgaccaggcagcccaggccgctgtgggccccagaggtgctctggagcagggcgccagggggaagaccgatgggccttggtggaagctgaggagaacggtgaccgtggtcctttgccagacgtccagatggtaagacttataatacagaaaccagctgtttctttccgcattaccgtgcacagtaataatgtgcctgtgtccgcagggtccatgttggtcataactaaagaccacctgcctttggaggtgtcttggagatggttaaactgctcttcagagatgtactgtaggatttttcgtcattcgatgaagatgtgtgcagccactccagggccttccctgggctgacggatccagctcacaccattctaatatcgttgagagagaacccagagatggtggcaggtcagcgtgaggggtctctgtgggtttcaccagcacaggacagactccttcaagtgacctggacaagaccaagagatcgtgacgcagctaaatcgagcaccggtcgtgtatatactgtctgatggcgcgagggaggcgatacg

SEQ ID NO: 792039 - DNA, 682 bp, Homo sapiens
  misc_feature: 43208.44.36.D03.1.pb.heavy.1.raw 43208
cgtatcgcctccctcgcgccatcagacagtatatacacgaccggtgctcgatttagctgcgtcacgatctctcttgggggagagcgagccccagccccagaattcccaggtgttttcatttggtgatcagcactgaacacagaggactcaccatggagtttcgggctgagctggttttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactaactgaaaccgaggacacgggcatgtattattgtgttgtgtttatatcaggaactgtccactgggccagggaacccctgtcaccgtctctcagctccaccaagggccatcgtcttccctggccctgctccaggagcacctccgagagcacagcggcctgggctgcctggtcaaggactacttcctatatactgtctgagcggctggcaaggcgcatag

SEQ ID NO: 792040 - DNA, 656 bp, Homo sapiens
  misc_feature: 43211.44.29.C07.1.pb.heavy.1.raw 43211
cgtatcgctccctcgcgccatcagacagtataatacacgaccggtgctcgatttagagtgctacgaaggggaaaggggactcctgtgtgccccccatggacaactttgctccacgctcgctgctgaccatcccttcatggtcttgtccccagatcaccttgaaggagtctgggtcctacgctggtgaaggcccacacagacctcacgctgacctgcaacctctctgggttctcactcaggagtgatggagcgattgtgggctgggtccgtcagcccccaggaaggcctggagtggcttgcactcatttattggatgatgataggcgctacagtccatctctgaaagggcaggactctccatcaccggagacgcctccaatacgcaggtgatccttagagtggccaacatggccctgcggaacacagccacatactactgcgcacacatgatcaactattataaaagtggtggttatgtgagtggctttgatatctggggcaaggacaatggtcacgtctcttcaagctcaccaagggccatcggtcttcccctggcgccctgctccaggagcaccttccgagagcacagcggccctgggctgcctgttcaaggactacttcctatatactgtcttagcgggctggcaaggcgcatg

SEQ ID NO: 792041 - DNA, 712 bp, Homo sapiens
  misc_feature: 43212.44.36.D03.1.pb.heavy.1.raw 43212
cgtatcgcctccctcgcgccatcagacagtatatacacgaccggtgctcgatttagctgcgtcacgatctctcttgggaggctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctggggaggcttggtacagcgggggggtccctgagactctcctgtgcagcctctggattcatcttcagtgactatgccatgaactgggtccgccaggctccagggaaggggctggagtgggttttcatatgttaatattgctggagataccacctactacgcagactctgtgaagggccgattcaccaattccagggacaatgccaagaactcactgtatcttgaaatgaacagcctgagagacgaggacacggctgtctacttctgttcgagagatcgggccacttggtcagtggctggttttgactactggggccggggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792042 - DNA, 702 bp, Homo sapiens
  misc_feature: 43227.44.27.C05.1.pb.heavy.1.raw 43227
cggtatcgcctccctcgcgccatcagacagtatatacacgaccggtgctcgatttagacgcgatcgaagggttttggggctggagacgagcccagcactggaagtcgccggtgtttccactcggtgatcatcactgaacacagaggactcaccatggagttttgggctgagctgggttttcctcgttgccctcttaagaggtgtcatgtgtcaggtgcaattcgtggagtctgggggaggcgtggcccagtaggggggtccctgagactctcctgtgcagcctctggattcaccttcgataattggaatatgcagtgggtccgcaggctccaggcgagggctggagtgggtggcaggtgtgtcatttcatggaggaaatcaagtctacggtgattccgttgaggggccgattcaccatctccagagacaattccgagaacacagtgtctcttcaaatgaacagcctgagacctcaggacacggcgtgtatttttgtgcgagactatctgtttccaaaatcggttcattcgacgcctgggccaggaaccctggtcaccgtctcctcggcctccaccaaggcccatcggtcttccccctggcgccctgctccaggagcacctccgagagcacagcgggccctgggctgcctggtcaaggactacttcctatatactgtctgagcggggctggcaaggcgcatag

SEQ ID NO: 792043 - DNA, 699 bp, Homo sapiens
  misc_feature: 43263.UNK.UNK.UNK.pb.heavy.1.raw 43263
gcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgcatccgtaagatgcttttctgtgactggtgagtactcaaccaagtcattctgagaatagtgtatgcggcgaccgagttgctcttgccggcgtcaatacgggataataccgcgccacatagcagaactttaaaagtgctcatcattggaaaacgttcttcggggcgaaaactctcaaggatcttaccgctgttgagatccagttcgatgtaaccccactcgtgcacccaactgatcttcagcatcttttactttcaccagcgtttctgggtgagcaaaaacaggaaggcaaaatgccgcaaaaaagggaataagggcgacacgggaaatgttgaatactcatactcttcctttttcaatattattgaagcatttatcagggttattgtctcatgagcggatacatatttgaatgtatttagaaaaataaacaaatagggttccgcgcacatttccccgaaaagtgccacctggtgc

SEQ ID NO: 792044 - DNA, 658 bp, Homo sapiens
  misc_feature: 43273.44.12.B01.1.pb.heavy.1.raw 43273
cgtatcgcctccctcgcgccatcagacagtatatacacgaccggtgctcgatttagtagtgtagattccgcgggggctttctgagagtcatggacctcctgtgcaagaacatgaagcactgtggttcttcctcctgctggtggcggctcccagatgggtcctgtcccagctgcagctgcaggagtcgggcccaggactggtgaagcttcggagaccctgtccctcacctgcactgtctctggtggctccatcagcagtagtagttactactggggctggatccgccagccccagggaaggggctggagtggattgggagtatctattatagtgggagcacctactacaacccgtccctcagagtcgagtcaccatatcagtagacacgtccaagaaccagttctccctgaagctgagctctgtgaccgccgcgacacgccgtgtattactgtgcgagagtagggcagtcgtcaccaactactttgaccactgggggccagggaaccctggtcccgtctcctcagcctccaccaagggcccatcggtctccccctggcacctcctccaagagcacctctggggggcacagcggccctgggctgcctggtcaaggactactttcctatatactgtctgagcgggctggcaaggcgcatag

SEQ ID NO: 792045 - DNA, 727 bp, Homo sapiens
  misc_feature: 43278.44.85.H08.1.pb.heavy.1.raw 43278
ctatgcgccttgccagcccgctcagacagtatataggaagtagtccttgaccaggcagtcagggccgctgtgcccccagaggtgctcttggaggagggtgccagggggaagaccgatgggcccttggtggagactgaggagacggtgaccgtggtccccttggcccagacgtccataccgtagtagtagtcccagcaggtggtagtactacaatatgtcctcgcacagtaatacacagccgtgtcctcggctctcaggctgttcatttgcagatacagcgtgttcttgaattgtctctggagatggtgaatcggcccttcacggagtctgcatagtatttattacttccatcataccatataagtggccacccactccagccccttggcctggagcctggcggacccagtgcatgccataggtacttgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccggaatggaaacaccgccgactttctagtgctgggctcctctcccagagctccccgcgactgagtgatactaaatcgagcaccggtcgtgtatatactgtctgatggcgccgagggaggcgatacg

SEQ ID NO: 792046 - DNA, 682 bp, Homo sapiens
  misc_feature: 43283.UNK.UNK.UNK.pb.heavy.1.raw 43283
cgtatcgcctccctcgcgccatcagacagtatatacacgacggtgctcgattagcactcgcacgttgggtttgggagaggagccagcactggattccgaggtgtttccattcggtgatcagcactgaacacagaggactcaccatggagttttggctgagctggttctccttgttggacttttaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtggtctcagtcatttatactggtgatttcacatactacgcagactccgtgaaggccgattcaccatctccagggacaattccaggaacacggtttatcttcaatgaacaacctgagaggcgacgacacggccgtctttactgtgcgagacaagtcggcgctcggagtggttattattcgtttgacttctgggccaggaaccctggtcaccgtcgcctccgcctccaccaaggcccatcgtcttcccctggcaccctcctcaagagcacctctggggcacagcggccctggctgcctggtcaaggactacttcctatatactgtctgagcggctggcaaggcgcatag

SEQ ID NO: 792047 - DNA, 700 bp, Homo sapiens
  misc_feature: 43295.UNK.UNK.UNK.pb.heavy.1.raw 43295
cgtatcgcctccctcggccccatcagacagtatatacacgaccggtgctcgatttaagagagagtgtgttgagctctgggcagaggagccccagccttgggattcccaggtgttttcatcagtgatcaggactgcaacacagaggactcaccatggagtttgggctgagctggattttccttgctgctattttaaaaggtgtccagtgtgaggtgcagttggtggagtctggggagggttggggtaaagcctggggagtcccttagactcgtcctgtgcagcctctggattcactttcagtaacgcctggatgacctgggtccgccaggctccaggaaagcgggctggagtggggttggccgtattagcaaccaaagctgacggtggggacagcagactacgctgcacccgtgaaaggcagattcaccatctcaagagatgattcaaaagatacggtgtctctgcaggatgaacagcctgaacaccgggaggacacagccgtctattactgtctgggatggtttcattcggggccagggaaccctggtcaccgtctcctcagcctccaccacaagggcccatcggtcttcccctggcgccctgctccaggagcaccctccgagagcacaggcggccctgggctgcctggtcaaggactacttcctatatacctgtctgagcggctggcaaggccgcatag

SEQ ID NO: 792048 - DNA, 656 bp, Homo sapiens
  misc_feature: 43309.44.86.H09.1.pb.heavy.1.raw 43309
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccagggcccatcggtcttccccctggcgccctgctccaggagcacctctgggggcacagcggccctgggctgcctggtcaagggactacttcctatatactgtctgagcgggctggcaaggcgcatag

SEQ ID NO: 792049 - DNA, 659 bp, Homo sapiens
  misc_feature: 43315.UNK.UNK.UNK.pb.heavy.1.raw 43315
cgtatcgcctccctcgcgccatcagacaggtatatacacgaccggtgctcgatttagtggctatagacttgggtttggggatgctttctgagagtcaaggacctcctgtgcaagaaacatgaagcacctgtggtttttcctcctgctggtgcagctcccagatgggtcctgtcccaggtgcagcctgcaggagtcgggcccaggactggtgaggccttcggaaccctgtctctcatctgcactgtctctggagtttccatcagttctgatcattcttggggctggatccggcagcccccaggcgaggggaatggagtggattggtgacatccattatactggggcgacgtactactctccgtccctcaagagtcgtctcaccattcgagggacaccgtccatgaaccgcttctcctgaaactgacctccgtgaccgccgcggacacggccgtttattctgtgcgaggcgagactgggtctttcaatctatggggcgcgtggcaccctggtcactgtccccctcagcttccaccaagggcccatcggtcttccccctggccgccctgctccagagcacctctgggggcaacagcggccctggctgcctggtcaaggactacttcctatatactgtctgagcgggctgcaaggcgcgatag

SEQ ID NO: 792050 - DNA, 695 bp, Homo sapiens
  misc_feature: 43388.44.27.C05.1.pb.heavy.1.raw 43388
ctatgcgccttgccagcccgctcagacagtatataggaagtagtccttgaccaggcagcccaggccgctgtgctctcggaggtgctcctggagcagggcgccaggggaagaccgatggccctggtggaggccgagagacggtgaccagggttcctggcccaggcgtcgaatgaaccgatttggaaacagatagtctcgcacaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggaccactgcatattccaattatcgaaggtgaatccagaggctgcacaggagagtctcagggacccccctactggggccacgcctccccagactccacgaattgcacctgacacatgacacctcttaagagggcaacgaggaaaaccagctcagcccaaaactccatggtgagtcctctgtgttcagtgatgatcaccgagtggaaacaccggcgacttccagtgctgggctcgtctcccagggcccccaaacccttcgatcgcgtctaatcgagcaccggtcgtgtatatactgtctgatggcgcgagggaggcgatacg

SEQ ID NO: 792051 - DNA, 666 bp, Homo sapiens
  misc_feature: 43389.44.6.A06.1.pb.heavy.1.raw 43389
ctatgcgccttgccagccgctcagacagtatataggaagtagtcttgaccaggcagcccagggccgctgtgccccagaggtgctcctggagcagggcgccaggggaagaccgatgggcccttggtggaagctgaggtgacaatgaccagggttcctgcccccagatctcaaaggctccatgcgagctggggtacggacctctcgcacagtagtagacggccgtgtcgtcggatttcaaagaactcattgtcatggagactgtgtctgtggacttgtccgcgtaatcgtaattctgccccggaagtctcgtgcgtaggtgagtgagccaaaaagagggatgattccacccatccactcaagccttgtccagggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccacacaagaggaacctccaggtccagtccatcggtgatgagctgtgctcccaggggcttctttagaggaggaatgtggttgtcagtagatctaaatcgagcaccggtcgtgtatatactgtctgatggcgcgagggaggcgatacg

SEQ ID NO: 792052 - DNA, 684 bp, Homo sapiens
  misc_feature: 43423.44.36.D03.1.pb.heavy.1.raw 43423
cgtatcgcctccctcgcgccatcagacagtatatacacgaccggtgctcgatttagctgcgtcacgatctctcttggggagctctgagagcggagccccagcccagaattccaggtgttttcatttggtgatcagcactgaacacgaggactcaccatggagttcggctgagctgggttttccttgttgttattttacaggtgtcagagtgaagtgcagttggtgagtccggggagactttggtccagcctggagggtccctgagactctcctgtgtcgcctctgattcaccatcagtgacactatatggactggggtccgccaggctccaggaaggggctgagtggcttggccgcagtaaaaacaagttgccagctttatcacagagtacgcccgcgtctgtgaaagccagatcaccctctcaagagatgactcaagaactcattgattctgcgaatgactaacctgaaaccgaggacacgggcatgtattattgtgttgtgtttatcaggaactgtccactgggccagggaaccctggtcaccgtctcctcacctccaccaagggccatcggtcttcccctggcgcctgctccaggagcacctccgagagcacagcggccctggctgcctggtcaaggactacttcctatatactgtctgagcgggctggcaaggcgcatag

SEQ ID NO: 792053 - DNA, 693 bp, Homo sapiens
  misc_feature: 43481.44.36.D03.1.pb.heavy.1.raw 43481
cgtatcgcccctcggcgccatcagacagtatataccacgaccggtgctcgatttagctgcgtcacgatctctcttgggagctctgagagcggaagccccagccccagaattcccaggtgttttcattgggtgatcagcactgaacacagaggactcaccatgggagttcgggctgagctggggttttccttgttttatttacaaggtgtccagagtgaagtgcagttggtgggtccgggggggacttgtccgctggagggccctgagactctcctgtgtcgcctctggattcaccatcagtgaccactatatggactggggtccgccaggctccagggaaggggctggagtggctgccgcagtaaaaacaaagttgccgttatcacagagtaccgccgcgtctgtgaagccgattcaccctcaagagatgacttcagaactcattgattctgcgaatgactaacctgaaaccgaggaccacggcatgtattattgtgttgtgttaatatcaggaactgtccactggggccagggaacgcctggtcaccgtctcctcagcccccaccaaggcgccatccggtcttccccccctggcgccctgctcaggaagcccctccgagagcacgcgccctgctgcctggtcaggactacttcctatatatactgtctgagcgggctggccaaggcgcatag

SEQ ID NO: 792054 - DNA, 683 bp, Homo sapiens
  misc_feature: 43545.44.56.F01.1.pb.heavy.1.raw 43545
cgttcgcctccctcgcgccatcagcagtatatacacgaccggtgctcgatttagcagacgtctgaacacacaagggagctctggagaggaccccagccgtgagattccaggagtttccacttggtgatccagcactgagcacagaccaccaccatggagtttggctaatcttgattttcttgtagttttttagaaggtgtccagtgccgaggggcgactggcgagtcggggggggcttggcacagccagggcggtctctgagactctcctgtgtagtctcaggattcagtcttaggatatcattggcctgggtccgtcagtctccagggaagggcttgagtggatcacttcgtcagaatgaaacgttattggtggaagtaaagagtacgccgggtcctggaaggaagattcaccgtccaagggtgctcccagtgtggcctttcaaatgagcacctgagacccgacgacacagggcgtctattacgcgccaggcgatcctgggacgtcgatgcattgatatttgggccaggggacatggtcaccgtctcttcagcttccaccaagggccatcggtcttccccctggcgccctgctccaggagcacctctggggcacagcggccctggctgcctggtcaaggacacttcctatatactgtctgagcgggctggcaaggcgcatag

SEQ ID NO: 792055 - DNA, 586 bp, Homo sapiens
  misc_feature: 43599.44.78.H01.1.pb.heavy.1.raw 43599
tgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggtccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttctcacctcagccccagactgcaccagctgtacctgggagtgggaccgtcagtcttcctcttccccccaaacccaaactactcacactaaatcgagcaccggtcgtgtatatactgtctgatggcgcgagggaggcgatacg

SEQ ID NO: 792056 - DNA, 613 bp, Homo sapiens
  misc_feature: 43605.UNK.UNK.UNK.pb.heavy.1.raw 43605
cgtatcgcctcctcgcgccatcagacagtatatacacgaccggtgctcgatttagtaacgtgattagggattgggcagggtgaacacctgtgttttttcctcctgctggtggcagctcccagatgggtcctgtcccaggtgcagctgcaggagtcggccccaggactggtgagggccttcgggaacccctgtctctccatctgcactgtctctggagtttccatcagttctgatcattcttggggctggatccggcagcccccagggaggggaatggagtggattggtgacatccattatactgggggcgacgtactactctccgtccctcagagtcgtctcaccatttcgagggacacgtccatgaacgctctcccctgaaactgacctccgtgaccgccgcggcacacgccgtttatttctgtgcgaggcgagactgtctttcaatctatgggccgtggcaccctgtcactgttctcagcttccaccaagggcccatcggtcttcccctggcgccctgctccaggagcacctctgggggcacagcggccctgggctgcctggtcaaggactacttcctatatactgtctgagcggctggcaaggcgcatag

SEQ ID NO: 792057 - DNA, 610 bp, Homo sapiens
  misc_feature: 43683.UNK.UNK.UNK.pb.heavy.1.raw 43683
gaaggctgggcaggctatgcaccctggtccaggtcaaaagctgcggaacccgctagcggccatcttggccactagggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgcgggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgaagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792058 - DNA, 624 bp, Homo sapiens
  misc_feature: 43685.UNK.UNK.UNK.pb.heavy.1.raw 43685
ccgaacacgccttgctagggacttggagctaaggaccaacatattgcctttagacagtcgaaggtgacgccttagctaccactgaacgttttaggcgccagatgcggtctgggatgacctaactcgcagcttatcgatgatcttactgcacgctcaaccaccaggtcttgatgccgccgcgataggactgacggatcgctacagaacatttaacctcgctagtaacttaattgagatcctagggactggaataggaaatagaaatcgcaccaccgcctatccacccccacatagcctgcttgggggtgttgagtttactttatttcgttgttggaatgagttgaacttccgggaaagtgagtaatgggtttgtctacttcccctaaccgcaaagtactagtttacgagtggcgtttgccaagccatagccagtcacaggtaataaacaattcaacgtggcgtaaagattggccgcttgctgtgggcattgcaagctgggtttgcagcattgtgcatgctagacgacaatatgaatctgcgggacccctagtggccagatgggccgctagcgggttccgcagcttttgacctggaccagggtgcatagcctgcccagccttcctc

SEQ ID NO: 792059 - DNA, 665 bp, Homo sapiens
  misc_feature: 43705.44.53.E09.1.pb.heavy.1.raw 43705
tgcgccttgccagcccgctcagacagtatataggaagtagtcttgaccaagcagcccagggccgctgtgctctcggaggtgctcctggagcagggcgccagggggaagacgatgcccttggtggaggctgaggagacggtgaccagggttcctggccgaatgaaaccatcccagacagtaatagacggctgtgtcctcggtgttcaggctgttcatctgcagagacaccgtatcttttgaatcatctcttgagatggtgaatctgcctttcacggtgcagcgtagtctgctgtccaccgtcagctttggttctaatacggccaaccactccagcccttccctggagcctggcggacccaggtcatccaggcgttactgaaagtgaatccagaggctgcacaggagagtctaaggactccccaggctttaccaaacctccccagactccaccaactgcacctcacactggacaccttttaaatagcagcaaggaaaatccagctcagcccaaactccatggtgagtcctctgtgttcagtcctgatcactgaatgaaaacacctggaatccaaggctggggctcctctcccagagctcaacacactctctctaaatcgagcaccggtcgtgtatatactgtctgatggcgcgagggaggcgatacg

SEQ ID NO: 792060 - DNA, 576 bp, Homo sapiens
  misc_feature: 43728.44.78.H01.1.pb.heavy.1.raw 43728
cgtatcgcctccctcgcgccatcagacagtatatacacgaccggtgctcgatttagtgtgagtagtttgggtttggggaagagaagactgacggtccactcccaaggtacagctggtgcagtctggggctgaggtgaagaagcctggggcctcagtgacagtctcctgcacggcttctggatacacgttcatcaattatgatattaacgggtgcgacaggcgctgacaagggctggagtggatgggatggatgaagccctatagtggcaacacggctttgcccagaagttccaggcagagttagtatgaccaggagcacctcctcaggtacagtctacatggaactgagcagcctgagatctgaggacacggccgtgtattttctgtgcgagagccaccagcacctggctttgacttgtggggccaggaaccctggtcacgtctcctcagctcacaagggcccatcggtcttcccctggcgccctgctccaggagcacctcgagagcacagcgcctggctgcctggtcaggactacttcctaatatactgtctgagcgggctggcaaggcgcatag

SEQ ID NO: 792061 - DNA, 689 bp, Homo sapiens
  misc_feature: 43736.44.36.D03.1.pb.heavy.1.raw 43736
cgtatcgcctccctcgcccatcagacagtatatacacgaccggtgctcgatttagctgcgtcacgatctctcttgggggagagcggagcccagccccagaattcccaggtgttttcatttggtgatcagcactgaacacagaggactcaccatggagttcgggctgagctgggtttttccttgttgttattttacaaggtgtccagagtgaagtgcagttggtggagtccggggagacttggtccagcctggagggtcctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggcaggaaccctggtcaccgtctcctcagcctccaccagggcccatcggtcttccctggcgccctgctccaggagcacctccgagagcacagcggccctgggctgcctggtcaaggactacttcctataactgtctgagcgggctggcaaggcgcatag

SEQ ID NO: 792062 - DNA, 588 bp, Homo sapiens
  misc_feature: 43771.44.78.H01.1.pb.heavy.1.raw 43771
cgtatcgcctccctcgcgccatcagacagtatatacacgaccggtgctcgatttagtgtgagtagttgggtttgggggaagaggaagactgacggtcccactcccaggtacagctggtgcagtctggggctgagtgaagaagcctgggggcctcagtgacagtctcctgcacggcttctggatacacgttcatcaattatgatattaactgggtgcgacaggccgctggacaagggctggagtggatgggatggatgaagccctatagtggcaacacgggcttgcccagagttccaaggcagagttagtatgaccaggagcacctccccaggtacagtctacatggaactgagcagcctgagatctgaggacacgccgtgtatttctgtgcgagagccaccagcacctggcttgactttgtggggccagggaaccctggtcaccgtctcctcagcctccaccaagggcccatcggtcttcccctggcgccctgctccaggagcacctccgagagcacagcggccctggggctgcctggtcaaggactacttcctatatactgtctgagcgggctggcaaggcgcatag

SEQ ID NO: 792063 - DNA, 638 bp, Homo sapiens
  misc_feature: 43803.44.86.H09.1.pb.heavy.1.raw 43803
ctatgcgccttgccagcccgctcagacagtatataggaagtagtccttgaccagcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggcgtgtccgcggcggtcacggaggtcagttcaggagaagcgttcatggacgtgtccctcgaaatggtgagacgactctgagggacggagagtagtacgtcgccccagtataatgatgtcaccaatccactccattccctccctgggctgccggatccagccccaagaatgatcagaactgatggaaactccagagacagtgcagatgagagacagggttcccgaaggcctcaccagtcctgggccgactcctgcagctgcacctgggacaggaccatctgggagctgccaccagcaggaggaaaaccacaggtgcttcatgttcttgcacagaggtccttgactctcagaaagcatccccaacccaagtctatagcactaaatcgagcaccggtcgtgtatatactgtctgatggcgcgaggaggcgatacg

SEQ ID NO: 792064 - DNA, 694 bp, Homo sapiens
  misc_feature: 43806.UNK.UNK.UNK.pb.heavy.1.raw 43806
cgtatcgcctccctcgcgccatcagacagtatacacgacgtgctcgattagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtcgggggagacttggtccagcctggagggtccctgagactctctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaaagaactcattgattctgcgaatgactacctgaaaaccgaggacacgggcatgattattgtgttgtgttttatatcaggaactgtccactggggccaggaaccctggtcaccgtctcctcagctccaccaaggcccatcggtcttccccctggcggcctgctccaggagcacctccgagagcacagcggccctgggctgcctggtcaaggactacttccctatatactgtctgagcgggctggcaaggcgcatag

SEQ ID NO: 792065 - DNA, 686 bp, Homo sapiens
  misc_feature: 43843.UNK.UNK.UNK.pb.heavy.1.raw 43843
ctatgcgccttgccagcccgctcagacagtatataggaagtagtccttgaccaggcagcccagggccgctgtgctctcggaggtgctcctggagcaggggccaggggaagaccgatgggcccttggtggaggctgaggagacggtgaccggggtccctggcccagtacgtatcctgatagtagaacacaacccacaataataccatgccgtgtcctcggttttcaggtagtcattcgcagatcaatgtttcttgagttgatctctggagaggtgaatctggcttcaagacgcgcgtactctgataagctggcacttttttttactgcggccgcactccagccccttccctggagcctggcggacccagtccatatagtggtcactgatggtgatccagaggcgacacaggagagtctcaggggaccctcccaggctggaccaagcctccccgactccaccagctgcacctgcactggacacctgctaataaggcaacgaggaaaacccagctcagcccaaactccatggtgagtcctctgtgttcagtgctgatcaccgaaatgaaaacaccgccgacttctgggtgctgggctccctctccagagctccccgcgagactggagtgagagctaaatcgagcaccggtcgtgtatatactgtctgatggcgcgagggaggcgatacg

SEQ ID NO: 792066 - DNA, 679 bp, Homo sapiens
  misc_feature: 43845.UNK.UNK.UNK.pb.heavy.1.raw 43845
cgtatcgctcctcggcgccatcagacagtatatacacgacggtgctcgatttagacgcgatcgaagggtttgggggcctgggagacgacagcacggcgaagtccgccccggtgtttccacctcggtgatcatcactgaacacagaggactcaccatggagtttgggctgagctgggtttcctcgttgccctcttaagaggtgtcatgtgtcagtgcaattcgtcggagctggggaggccgtggccagtaggggggctgagatctcctgtgcagctctggattcaccttcgataattggaatatgcagtgggtccgccaggctccaggcgagggctggagtggtgcaggtgtgtcatttcatggaggaaatcaagtctacggtgattccgttgaggccgattcaccattccagagacattccgagaacacagtgtcttccaaatgaacagcctgagacctcaggacacggccgtgtattttttgtgcgagactatctgtttccaaatcggttcattcgacgcctgggccagggaaccctgtcacgtctctcggctccccaagggcccatcgtcttcccctgcgccctgctccaggagcacctccgagagcacagcggcctggctgcctggtcaaggactacttcctatatactgtctgagcgggctggcaaggcgcatag

SEQ ID NO: 792067 - DNA, 671 bp, Homo sapiens
  misc_feature: 43860.UNK.UNK.UNK.pb.heavy.1.raw 43860
ctatgcgccttgccagcccgctcagacagtatataggaagtagtcctttgaccaggcagcccagggccgctgtcttcggaggtgctctggagcagggcgccagggaagaccgatgggccctggtggagggctgaggagacggtgaccagggttccctggccgaatgaaaccatcccagacagtaagacggctgtgtcctcggtgttcaggctgttcatctctgcagagacaccgtatcttttgaattcatctcttgagatggtgaatctgcctttcacggtgcagcgtagtctgctgtccaccgtcagcttggttctaatacggccaaccactccagcccttcctggagcctggcggacccaggtcatccaggcgttactgaaagtgaatccagaggctgcacagggagagtctaagggactccaggctttttaccaaacctccagatccccaactgcacctcacactggacaccttttaaaatagcagcaggaaaatccagctcagcccaaactccatggtgagtcctctgtgttcagtcctggatcactgaatgaaaacacctgggaatcccaaggctggggctcctctcccagagctcaacgacactctctctaaatcgagcaccggtcgtgtatatactgtctgaatggcgcgagggaggcgatacg

SEQ ID NO: 792068 - DNA, 706 bp, Homo sapiens
  misc_feature: 43882.44.36.D03.1.pb.heavy.1.raw 43882
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggcctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtcactggggccagggaaccctggtcaccgtctcctcagcctccaccaagggcccatcggtcttccccctggcgccctgctccaggagcacctccgagagcacagcggcccctgggctgcctgtcaaggactacttcctatataactgtctgagcgggctggcaaggcgcatag

SEQ ID NO: 792069 - DNA, 707 bp, Homo sapiens
  misc_feature: 43886.44.27.C05.1.pb.heavy.1.raw 43886
cgtatcgcctccctcgcgccatcagacagtaattatacacgaccggtgctcgatttagacgcgatcgaagggttgggaggccctgggagacgagcccagcactggaagtcgccggtgtttccccattcggtgatcatcactgaacacaagaggactcaccatggagttgggctgaagcctgggttttcctcgttgccctctaagaggtgtcatgtgtcaggtgcaattcgtggagtctgggggaggcgtggccccccagtaggggggtccctgagactctcctgtgcagctctggattcacttccgataattggaatatgcagtgggttccgccaggcccaggcgaggggctggagtgggtggcaggtgtgtcatttcatggaggaaatcagatctacggtgattccgttgagggccgattcaccatctccagagacaattcgagaacaacagtgtctcttcaaatgaacagcctgagacctcaggacacggccgcgtgtattttgtgcgagactatctgtttccaaatcggttcattcgacgcctggggccagggaaccctggtcaccgtctcctcggcctccaccaagggccatcggtctcccctggcgcctgctccaggagcacctccgagagcacagcggccctggctgcctggtcaaggactacttctatatactgtctgagcgggctggcaaggcgcatag

SEQ ID NO: 792070 - DNA, 643 bp, Homo sapiens
  misc_feature: 43891.UNK.UNK.UNK.pb.heavy.1.raw 43891
gaaggcggcaggctagtgcaccctgggtccaggtcaaaagctgcggaacccgctagccggcccatcttggccactagggcgcggtccgcagattcatattgtcgtctagcatgcacaatgctgcaaaacccagctttgccaatgcccacagcaagcgggccaatctttacgccacgttgaattgtttattacctgtgactggctatggctttgcaacgccactcgtaaactagtactctttgcggttaggggaagtagacaaacccattactccacttccggaagttcaactcattccaacacgaataaaagtaaactcaacaccccaagcgcagctattggggggggcggtgataggggtggattctatttccgctatcccatcccctaggatctcaattaaggggttactagcggagtaaatgtctgtagcgatcccgtcagtccgtatcgcggcgcatcaagacctgggtggttgagcgtgcgagtagattcatcgataagctgcgagttaggtctcatcccagaccgcatctggcgcctaaacgtttcccagtggtagcttaaggcgtcaccgcttcgactgtctaaaggcaatatgtgcgtcttagctccaggagtccctagcaagcggtgtcggggg

SEQ ID NO: 792071 - DNA, 619 bp, Homo sapiens
  misc_feature: 43900.44.23.C01.1.pb.heavy.1.raw 43900
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaaccgcttctccctgaaactgacctccgtgaccgccgcggacacggccgtttatttctgtgcgaggcgagactggtctttcaatctatgggccgtggcaccctggtcactgtctcctcagcttccacaagggcccatcggtcttccccctggcgccctgctccaggagcacctctgggggcacagcggccctgggctgcctggtcaaggactacttcctatatactgtctgagcggctggcaaggcgcatag

SEQ ID NO: 792072 - DNA, 645 bp, Homo sapiens
  misc_feature: 43905.UNK.UNK.UNK.pb.heavy.1.raw 43905
ctatgcgccttgcagcccgctcagacagtatataggaagtagtccttgaccaggcagtccaggccgctgtgcccccagaggtgctcctggagcagggcgccagggggaagaccgatggcccttggtggaagctgaggagacagtgaccagggtgccacggccccatagattgaaagaccagtctcgcctcgcacagaaataaacggccgtgtccgcggcggtcacggaggtcagtttcaggagaagcggttcatggacgtgtccctcgaaatggtgagacgactcttgaggacggagagtagtacgtcgccccagtataatggatgtcaccaatccactccattccctccctgggggctgccggatccagcccaagaatgatcagaactgatggaaactccagagacagtgcagatgagagacagggttcccgaaggcctcaccagtcctggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaatcgagcacgggtcgtgtatatactgtctgatggcgcgagggaggcgatacg

SEQ ID NO: 792073 - DNA, 694 bp, Homo sapiens
  misc_feature: 43910.UNK.UNK.UNK.pb.heavy.1.raw 43910
cgtatcgcctcccctcgcgccatcagacagtatatacacgaccggttgctcgatttagcacaccgatagttgggtttggggatactttctgagactcatgggcctcctgcacaaagaacatgaaacacctgtggttcttctccctcctggtggcacctcccagatgggtcgtgtccgaggtgcagctgcaggagtcgggcccaggacgggtgaaggccttcggagaccctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtcaagaaccagttctccctgaaattgacttctgtgaccgccgcggaccacggccgtatattattgtgcgagagattcctatcgatactacgtagagacgggggggcgaactggctcgacccctggggccagggaacccctggtcacccgtctcctcaagcctccaaccaagggcccatcggtcttccccctggcacccctcctccaagagcacctctgggggcacagcggccctgggctgcctggtcaaaggactacttccttatactgtcgtctgagcgggctggcaaggcgcatag

SEQ ID NO: 792074 - DNA, 690 bp, Homo sapiens
  misc_feature: 43923.UNK.UNK.UNK.pb.heavy.1.raw 43923
ctatgcgccttgcagccgctcagacagtatataggagtagtctgaccaggcagcccagggccgctgtgctctcggaggtgctcctggagcagggcgccaggggaagaccgatgggcccttggtggaggccgaggagacggtgaccagggttccctggccccagcgtcgaatgaaccgatttggaacagatagtctcgcacaaaaatacacggccgtgtcctgaggtctcaggctggttcatttgaagagacactgtgttctcggaatgtctctggagatggtgaatcgccctcaacggaatcaccgtagacttgatttcctcatgaaatgacacacctgccacccactccagcccctcgcctggagcctggcggacccactgcatattccaattatcgaaggtgaatccagaggctgcacaggagagtctcagggaccccctactgggccacgcctcccccagactcacgaattgccacctgacacatgacacccttaagaggggcaacgaggaaacccagctcagccccaactcatggtgagtcctctgtgttcagtgatgatcaccgagtggaaacaccgcgactgtcagtgctgggctcgtctcccagggctccccaaacccttcgatcgcgtctaaatcgagcacggtcgtgtatatactgtctgaggcgcgagggaggcgatacg

SEQ ID NO: 792075 - DNA, 655 bp, Homo sapiens
  misc_feature: 43976.44.23.C01.1.pb.heavy.1.raw 43976
cgtatcgcctccctcgcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactggtctctggagtttccatcagttctgatcattcttggggctggatccggcagccccagggagggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgttctcctcagcttccaccaaggcccatcggtcttcccctggcgccctgctccaggagcacctctgggggcacagcggccctgggctgcctggtcaaggactacttcctatatactgtctgagcgggctggcaaggcgcatag

SEQ ID NO: 792076 - DNA, 722 bp, Homo sapiens
  misc_feature: 43988.UNK.UNK.UNK.pb.heavy.1.raw 43988
cgtatcgcctccctcgcgccccatcagacaagtatataccacaccggctcgatttacactcgcacgttgggtttgggggggagaggagcccagcactgggatcttcgaggtgttttcattcggtgatcagcactgaacacagaggactcaccatggagtttttggctgagctgggttctccttgtttggacttttaaaagggtgtgtccagtgtgaggtgcggggctgatggagtctggaggaggcttagtccagcctggggggtcccagagactctcctgtgcagctctgggctccaccgtcagcagcaactacatggattgggtccgccaggctccagggaaggggctggagtgggtctcagtcatttatactggttgatttcacatactacgcagactccgtgagcggcccgattcaccatctccagggacaattccagacacggtttatcttcaaatgaacacctgagagggcgacgacacgggccgtctattactgtgcgaggacaagtcggcgctcgggagtggttattattcgtttgacttctgggccagggaaccctgggtcacggcgtcgcctccgcctccaccaaggggcccatcggtcttcccccctggcacccctcctccaagagcactctggggcacagcggccctggctgccctggtcaaggactacttcctatatactgtctgagcgggctgggcaaggcggcatag

SEQ ID NO: 792077 - DNA, 695 bp, Homo sapiens
  misc_feature: 44000.44.27.C05.1.pb.heavy.1.raw 44000
ctatgcgccttgcagcccgctcagacagtatataggaagtagtccttgaccaggcagcccagggccgctgtgctctcggaggtgctcctggagcagggcgccaggggggagaccgatgggcccttggtggaggccgaggagacggtgaccagggttccctggccccaggcgtcgaatgaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgattcctccatgaaatgacacacctgccacccactccagccctcgcctggagcctggcggacccactgcatattccaattatcgaaggtgaatccagaggctgcacaggagagtctcagggacccccctactggggccacgctcccccagactcacgaatgcacctgacacatgacacctcttaagaggcaacgaggaaacccagctcagcccaaactccatggtgagtcctctgtgttcagtgatgatcaccgagtggaaacaccggcgacttccgtgctgggctcgtctcccagcccccaaacccttcgatcgcgtctaaatcgagcaccggtcgtgtatatactgtctgatggcgcgagggaggcgatacg

SEQ ID NO: 792078 - DNA, 689 bp, Homo sapiens
  misc_feature: 44036.44.74.G08.1.pb.heavy.1.raw 44036
cgtatcgcctccctcgcgccatcagacagtatatacacgaccggtgctcgatttagtagctctatcagggggagcatcacataacaaccacattcctcctctaaagaagccccctgggagcacagctcatcaccatggactggacctggaggttcctctttgtggtggcagcagcaacaggtgtccagtccctggtggcaactggtgcagtctggactagaatgccgcaaccttggtcctcggtgaccctttcctgcacggcctctggaatactaccagttccactacttataccatcaactgggtgcgccaggcccctggacaagggcttgagtggatgggtggaatcatccctctttttggctcactcacctacgcaccgagacttccggggagaattacgattaccgcggacaagtccacagacacagtctcctgacaatgagttctttgaaatccgacgacacggccgtctactactgtgcgagaggtccgtaccccagctcgcatgagcctttgagatctgggggcagggaaccctggtcattgtcacctcagcttccaccaagggcccatcggtcttcccctggcgccctgctccaggagcacctctgggggcacagcggccctgggctgcctgtcaaggactacttcctatatactgtctgagcggctggcaaggcgcatag

SEQ ID NO: 792079 - DNA, 662 bp, Homo sapiens
  misc_feature: 44080.44.12.B01.1.pb.heavy.1.raw 44080
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggggcggctccagatgggtcctgtcccagctgcagctgcaggaagtcgggcccaggactggtgaagccttcgagaccctgtccctcacctgcactgtctctggtgggctccatcagcagtagtagtttactactggggctggatccgccagcccccagggaaggggctggagtggattgggagtatctattatagtgggagcacctactacaaccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggccaccctctccaagagcacctctggggcacagcggccctgggctggcctgtcaaggactacttcctatatactgtctgagcggctggcaaaggcgcatag

SEQ ID NO: 792080 - DNA, 738 bp, Homo sapiens
  misc_feature: 44137.44.62.F07.1.pb.heavy.1.raw 44137
cgtacgcctccctccgccgcccatcagacaggtataacacgaccggtgctcgatttagtagtcgcataaagggaaaggggagctctgagagagggagcccagccccgggatttcaggtgtcttcatttggtgaccaggaaccgaacagagagaagtctcccatggagtttgggctgagctgcctttttcttggtggctttttaaagggtgtcgtgtggtgaagtgcagttgttggagtctggggggggggcctgattcggcctgggaggtccctgaccctctcctgtgcggcctctgggattcacctttagtgcctatggcaatgacctggggtccgccgggctccaggggggggactggagtggggggggtctcaagtatcggagctggtgggtgtcactttctacggagactccgtgaaggccgcttcaccattttccagggacaattcgcaggacaaaattgtttctccaaatgaaaaaacctgaggacccgaggacacaggcggtctattactgttttgaaagccaggaccacgggtgacccccccatgacacctttagtacttggggccgggggacagtggtgaccgtctcttcagcctccacaagggcccatcggtcttccccctggccccctgctccaggagcacctccgagaggcacagcggccctgggctgcctggtcaagggactacttcctatatactgtctgagcgggcctggcaaggcgcataga

SEQ ID NO: 792081 - DNA, 683 bp, Homo sapiens
  misc_feature: 44150.44.6.A06.1.pb.heavy.1.raw 44150
cgtatcgcctcctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcgtctgggactagaatgccgcaaccttggtctcggtgaccctttcctgcacggcctctggaagtactaccagttccactacttataccatcaactgggtgcgccaggcccctggacaagggcttgagtggatgggtggaatcatccctctttttggctcactcacctacgcacgagaacttccggggcagaattacgattaccgcgcggacaagtccacagacacagtctccatgacaatgagttcctttgaaatccgacgacaccggccgtctactactgtgcgagaggtccgtaccccagctcggcatggagcctttgagatctggggcagggaaccctggtcattgtcacctcagctttccaccaagggccccatcggtctttcccccctggcgccctgctccaggagcacctctgggggcacagcggccctgggctgccctggtcaaggactactttcctatatactgtctgagcgggctggcaaggcgcatag

SEQ ID NO: 792082 - DNA, 656 bp, Homo sapiens
  misc_feature: 44171.44.86.H09.1.pb.heavy.1.raw 44171
catgcgccttgccagcccgctcagacagtatataggaagtagtccttgaccaggcagcccagggccgctgtgccccagaggtgctcctggagcagggcgccagggggaagaccgatggcccttggtggaagctgaggagacagtgaccagggtgccacggccccatagatttgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggggcctggccggatccagccccaagaatgatcagaactgatggaaactccagagacagtgcagatgagagacagggttccccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatcccaaaacccaagtctatagcactaaatcgagcaccggtcgtgtatatactgtctgatgcgcgagggaggcgatacg

SEQ ID NO: 792083 - DNA, 703 bp, Homo sapiens
  misc_feature: 44193.44.71.G05.1.pb.heavy.1.raw 44193
cgtatcgcctccctcggcgccatcagacagtatatacacgaccggtgctcgatttagtgtcgtcgcaagagagaggagcccccagccgtgagattcccaggagttttccacttggtgatcagcactgagcacagaccaccaaccatggagtttgggcctaatcttgattttccttgtagtttttttagaagggtgtccagtgcgagggggcgactggcggagtcggggggggcttggcacagccagggcgggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggccacagcgccctgggctgcctggtcaaggactacttcctatatactgtctgagcgggctggccaaggcgcatag

SEQ ID NO: 792084 - DNA, 586 bp, Homo sapiens
  misc_feature: 44214.44.38.D05.1.pb.heavy.1.raw 44214
tataggaagtagtccttgaccaggcagcccaggcgcctgtgcccccagaggtgctcctggagcagggcgccaggggggaaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggccccttcacggagtccgcgtagcttgtgctactcccatcactattaatacgtgagacccacaccagccccttcctggagcttgcggacccagtgcatccagtagctactgaaggtgaatccagaggctgcacaggagagtctcaggacccccaggctgaactaagctcccccggactccaccagctgcacctcacactggacaccctttaaaatagcaacaaggaaaaccccagctatcagatactaaatcgagcaccggtcgtgatagtatagactgatggcgcgagggaggcgatacg

SEQ ID NO: 792085 - DNA, 710 bp, Homo sapiens
  misc_feature: 44222.44.62.F07.1.pb.heavy.1.raw 44222
ctatgcgccttgccagcccgctcagacagtatataggaagtagtccttgaccaggcagcccagggccgctgtgctctcggaggtgctcctggagcagggcgccagggggaagaccgatgggccttggtggaggctgaagagacggtcaccactgtcccccggccccaagtactaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggcccccccagactccaacaactgcacttcacacacgacacccctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 792086 - DNA, 699 bp, Homo sapiens
  misc_feature: 44226.UNK.UNK.UNK.pb.heavy.1.raw 44226
ctatgcgccttgccagcccgctcagacagtatataggaagtagtccttgaccaggcagcccagggccgctgtgctctcggaggtgctcctggagcagggcgccaggggaagaccgatggcccttggtggaggctgaggagacggtgaccagggttccccggcccagtgtcaaaaccagccactgaccaagtggcccgatctctcgacagaagagacagccgtgtcctcgtctctcaggctgttcatttccagatacagtgagtcttggcattgtccctggaattggtgaatcggccttcacagagtctgcgtagtaggtggtatctccagcaatattaacatatgaaacccactccagccccttccctggagcctggcggaacccagttcatggcatagtcactgaagatgaatccagaggctgcacaggagagtctcagggacccccccgctgtaccaagcctccccagactccaccagccgcacctcacagtggacaccttctaaaatagcaacaaggaaaacccagcgcagccccaactccatggtgagtcctctgtgttcagtgctgatcaccaagtggaaatgccttggaatccagggctaagcacctctctgagagctcccaagagagatcgtgcgcagcaatcgagcaccggtcgtgtatatactgtctgatggcgcgagggaggcgatacg

SEQ ID NO: 792087 - DNA, 705 bp, Homo sapiens
  misc_feature: 44238.UNK.UNK.UNK.pb.heavy.1.raw 44238
ctatgcgccttgccagcccgctcagacagtatataggaagtagtccttgaccaggcagcccagggccgctgtgctctcggaggtgctctggagcagggcgcgccagggggaagaccgatgggcccttggtggagggccgaggagacggtgaccagggttccctggccccaggcgtcgaatgaaccgattttggaaacagatagtctcgcacaaaaatacacggccgtgtcctgaggtctcaggctgttcatttgaagagacactgtgttcctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccgggcgacttccagtgctgggcctcgtctcccaggccccaaacccttcgatcgcgtctaaatcgagcaccggtcgtatactgtctgatggcgcgagggaggcgatacg

SEQ ID NO: 792088 - DNA, 707 bp, Homo sapiens
  misc_feature: 44246.44.36.D03.1.pb.heavy.1.raw 44246
cgtatcgcctccctcgcgccatcagacagtatatacacgaccggtgctcgatttagctgcgtcacgatctctcttgggagctctgagagcggagccccagccccagaattcccaggtgtttttcatttggtgatcagcactgaacacagaggactcaccatggagttcgggctgagctgggttttccttgttgttatttttacaaggtgtcccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcacccctctcaagagatgacttcaagaactcattgattctgcgaatgactaacctgaaaaccggaggaccacggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcggctggcaaggcgcatag

SEQ ID NO: 792089 - DNA, 703 bp, Homo sapiens
  misc_feature: 44257.44.36.D03.1.pb.heavy.1.raw 44257
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaggcgcatag

SEQ ID NO: 792090 - DNA, 704 bp, Homo sapiens
  misc_feature: 44272.44.73.G07.1.pb.heavy.1.raw 44272
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactgggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792091 - DNA, 702 bp, Homo sapiens
  misc_feature: 44284.44.27.C05.1.pb.heavy.1.raw 44284
ctatgcgccttgccagcccgctcagacagtatataggaagtagtccttgaccaggcagccaggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcgaattgtctctggagatggtgaatcggccctcaacggaatcaccgtagactgatttcctccatgaaatgacacacctgccacccactccagcccctcgcctggagcctggcggacccactgcatattccaattatcgaaggtgaatccagaggctgcacaggagagtctcagggacccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 792092 - DNA, 667 bp, Homo sapiens
  misc_feature: 44335.44.21.B10.1.pb.heavy.1.raw 44335
cgtatcgcctccctcgcgccatcagacagtatatacacgaccggtgctcgatttagtgtcgtcgcaaggagaggggccagccctgggactggacagagagaactcaccatggagtttgggctgagctggctttttcttgtggctgttttaaaaggtgtccagtgtgaagtgcagctgttggagtcgggggaggcttggtacagccggggggtccctgacactctcctgtgcagcctctggattcgcctttaatacctatgccatgatctgggtccgtcaggccccagggaagggctggagtgggtctcatccattactggtggtagtgccacaaatgtcgcagactcccgtgaagggccgcttcatcgtctccagggacaattccaagaatacggtgtttctgcagatgaagagcctgcgagtggacgacacgccctttattactgtgcagagggtcgcagaagttacaacaatacaagtattactactacatggacgtctgggcaaaggaccccggtcaccgtctcctcagcctccaccaagggcccatcggtcttccccctggcaccctcctccaagagcacctctgggggcacagcggccctgggctgcctggtcaaggactacttcctatatactgtctgaggcgggctggcaaggcgcatag

SEQ ID NO: 792093 - DNA, 644 bp, Homo sapiens
  misc_feature: 44344.44.86.H09.1.pb.heavy.1.raw 44344
tatgcgcctttgccagcccgctcagacagtatataggaagtagtccttgaccaggcagcccagggccgctgtgcccccagaggtgctcctggagcaggcgccagggggaagaccgatgggcccttggtggaagctgagagacagtgaccagggtgccacggccccatagattgaaagccagtctcgcctcgcacagaaataaacggccgtgtccgcggcggtcacggaggtcagtttcagggagaagcggttcatggacgtgtcctcgaaatggtgagacgactcttgagggacggagagtagtacgtcgcccagtataatggatgtcaccaatccactccattcccctcctggggctgccggatccagccccaagaatgatcagaactgatggaaactccaggacagtgcagatgagagacagggttcccgaaggcctcaccagtcctgggcccgactcctgcagctgcacctgggacaggacccatctgggagctgccaccagcaggaggaaaaacacaggtgcttcatgttcttgcacaggaggtccttgactctcagaaagcatccccaacccaagtctatagcactaaatcgagcaccggtcgtgtatatactgtctgatggcgcgaggaggcgatacg

SEQ ID NO: 792094 - DNA, 680 bp, Homo sapiens
  misc_feature: 44346.44.74.G08.1.pb.heavy.1.raw 44346
ctatgcgccttgccagcccgctcagacagtatataggaagtagtccttgaccaggcagccagggccgctgtgccccagaggtgctcctgagcagggcgccaggggaagaccgatgggcccttggtggaagctgaggtgacaatgaccagggttccctgccccagatctcaaaggctccatgcgagctggggtacggacctctcgcacagtagtagacggccgtgtcgtcggattcaaagaactcatgtcatggagactgtgtctgtggacttgtccgcggtatcgtaattctgcccggaagtctcgtgcgtaggtgagtgagccaaaaagaggatgattccacccatccactcaagcccttgtccagggcctggcgcacccagtgatggtataagtagtggaactgtagtacttccagaggccgtgcaggaaagggtcaccgaggaccaaggttgcggcattctagtccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 792095 - DNA, 675 bp, Homo sapiens
  misc_feature: 44354.44.36.D03.1.pb.heavy.1.raw 44354
gctcagacagtatataggaagtagtccttgaccaggcagcccaggcccgctgtgctctcggaggtgctcctggagcagggcgccagggggaagacgatgggcccttggtggaggctgagagacggtgaccagggttcctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagcccttcctggagcctggcggacccagtccatatagggtcactgatggtgaatccagaggcgacacaggagagtctcagggaccctccaggctggaccaagtctccccggactccaccaactgcacttcactctggacaccttgtaaaataacaacaaggaaacccagctcagcccgaactccatggtgagtcctctgtgttcagtgctgatcaccaaatgaaaacacctgggaattctggggctgggctccgctctcagagctcccaagagagatcgtgacgcagctaatcgagcaccggtcgtgtatatactgtctgatggcgcgagggaggcgatacg

SEQ ID NO: 792096 - DNA, 690 bp, Homo sapiens
  misc_feature: 44371.44.55.E11.1.pb.heavy.1.raw 44371
cgtatcgcctccctcgcgccatcagacagtatatacacgaccggtgctcgatttagcactcgcacgttgggtttggggagaggagcccagcactgattccgaggtgtttccattcggtgatcagcactgaacacagaggactcaccatggagttttggctgagctgggttctccttgttggactttaaaggtgtccagtgtgaggtgcggctgatggagtctggaggaggcttagtccagcctggggggtcccagagactctcctgtgcagcctctgggctcaccgtcagcagcaactacatgagttggtccgccaggctccagggaaggggctggagtgggtctcagtcatttatactggtgatttcacatactacgcagactcgtgaaggccgattcaccatctccagggacaattccaggacacggtttatcttcaaatgaacaacctgagaggcgacgacacggccgtctatttactgtgcgagacaagtcggcgctcggagtggttattattcgtttgacttctgggccagggaaccctggtcacgtcgcctccgcctccaccaagggccatcggtcttcccctggcaccctcctccaagagcacctctgggggcacagcggcctgggctgcctggtcaaggactacttcctatatactgtctgagcggctggcaaggcgcatag

SEQ ID NO: 792097 - DNA, 693 bp, Homo sapiens
  misc_feature: 44402.44.55.E11.1.pb.heavy.1.raw 44402
cgtatcgcctccctcgcgccatcagacagtatatacacgaccggtgctcgatttagcactcgcacgttgggttttgggagaggagcccagcactggattccgaggtgtttccattcggtgatcagcactgaacacagaggactcaccatggagtttggctgagctgggttctccttgttggacttttaaaaggtgtccagtgtgaggtgcggctgatggagtctggaggaggcttagtccagcctggggggtccagagactctcctgtgcagcctctgggctcacgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctgtcaccgtcgcctccgcctccaccaagggcccatcggtcttcccctggcaccctcctccaagagcacctctggggcacagcggcctgggctgcctggtcaaggactactttatatactgtctgagcgggctggcaaggcgcatag

SEQ ID NO: 792098 - DNA, 717 bp, Homo sapiens
  misc_feature: 44414.44.86.H09.1.pb.heavy.1.raw 44414
ctatgcgccttgcagccgctcagacagtatataggaagtagtccttgaccaggcagcccagggccgctgtgcccccagaggtgctcttggaggagggtgcaggggaagaccgatgggcccttggtggaggctgaggagacggcgacgtggtcccttggccccagcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcctcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaaggcaacgaggaaaacccaggtcagcccaaactccatggtgagtcctctgtgttcggtgctgatcaccgactggaaacacgccgacttctggtgctggctcctctcccagagctccccaacccaagtctatagcactaaatcgagcaccggtcgtgtatatactgtctgatggcgcgagggaggcgatacg

SEQ ID NO: 792099 - DNA, 714 bp, Homo sapiens
  misc_feature: 44430.UNK.UNK.UNK.pb.heavy.1.raw 44430
ctatgcgccttgccagcccgctcagacagtatataggaagtagtccttgaccaggcagccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtcctcgcacaaaaatacacggccgtgtctgaggtctcaggctgttcatttgaagagacactgtgttctcggaattgtctctggagatggtgatcggccctcaacggaatcaccgtagacttgatttcctccatgaaatggacacactgccacccactccagcccctcgcctggagcctggcggacccactgcatattccaattacgaaggtggaatccagaggctgcacaggagagtctcagggaccccccctactggggccacgcccctccagactcacgaattgcacctgacacatgacacctcttaagagggcaacggaggaaaacccaggctcaggcccaaactccatggtgagtcctctgtgttcagtgatgatcacccgagtggaaacaccggcgacttccagtgctgggctcgtctcccagggctcccaaacccttcgatcgcgtctaaatcgagcacccggtcgtgtatatactgttctgatggcgcggcgagggaggcgaatacg

SEQ ID NO: 792100 - DNA, 700 bp, Homo sapiens
  misc_feature: 44446.UNK.UNK.UNK.pb.heavy.1.raw 44446
ctatgcgccttgccagccgctcagacagtatatagggaagtagtccttgaccaggcagccagggccgctgtgcccccagagtgctcttggaggagggtgccaggggaagacgatgggcccttggtggaggcggaggcgacggtgaccagggttccctggcccagaagtcaaacgaataataaccactccgagcgccgacttgtctcgcacagtaatagacggccgtgtcgtcgcctctcagggttgttcattgaagataaaccgtggttcctggaattgtccctggagatggtgaatcggcccttcaggagtctgcgtagtatgtgaaatcacccagtataaatgactgagaccccactccagccccttcctggagctggcggacccaactcatgtagttgctgctgacggtgaggcccagaggctgcacaggagagtctctggaaccccccaggctggactaagcctcctccagactccatcagccgcacctcacactggacaccttttaaaagtcccaacaaggagaacccagctcagccaaaactccatggtgagtcctctgtgttcagtgctgatcaccgaatgaaaacacctcggaatcccagtgctgggccctctccccaacccaacgtggcgagtgctaaatcgagcaccggtcgtgtatatactgtctgatggcgcgcagggaggcgatacg

SEQ ID NO: 792101 - DNA, 680 bp, Homo sapiens
  misc_feature: 44502.44.73.G07.1.pb.heavy.1.raw 44502
cgtatcgcctcctcgcgccatcagacagtatatacacgaccggtgctcgatttagctctacgctcagggccgctgtgctctcggcggtgttttccattcggtgatcagcactgaacacagaggactcaccatggagtttgggctgagctggtttttctcgttactcttttaagaggtgtccagtgtcaggtgcacctggtggagtctggggaggcgtggtccagcctgggaggtccctgagactctcctgtgaagcctctggatttttagtttcagtagttctggcatgcactggtcgccaggctccaggcaaggcgcgagtggttggcagttatagcatatgatggaacttctagatattatgcagactcgtgaagggccgattcaccatctcagagacaattcccggacacactctgtacctggaaatgatcagcctgagaggcgagggactcgctctgtattactgtgcgagatcggaagtggcagcagctattatcgggcgtttcactggggccaggggacactggtcaccgtctcctcagccccaccaagggcccatcggtcttccccctggcgccctgctccaggagcacctccgagagcacagcgccctgggctgcctggtcaagggactgacttcctatatactgtctgagccggctgggcaaggcgcatag

SEQ ID NO: 792102 - DNA, 680 bp, Homo sapiens
  misc_feature: 44519.44.36.D03.1.pb.heavy.1.raw 44519
cgtatcgccctccccgcgccatcgacagtatatacacgaccggtgctcgatttagctgcgtcacgatctctcttggggagctctgagagcggagccagccagaattcccaggtgttttcatttggtgatcagcactgaacacagagactcaccatggagttcgggctgagctggttttccttgttgttattttacaggtgtccagagtgagtgcagttggtggagtcgggggagactggtccagcctggagggtccctgagactctctgtgtcgcctctggattcaccatcagtgaccactatatgactggtcgccaggctccagggaagggctggagtgcttggccgcagtaaaacaaagttgccagctttatcacagagtacgccgcgtctgtgaagccagattcaccctctcaagagatgacttcaagaatcattgattctgcgaatgactaacctgaaaaccgaggacacggcatgtattattgtgttgtgtttatatcaggaactgtccactggggccagggaaccctggtcaccgtctcctcagcctccaccaaggcccatcggtcttccccctggcgcctgctccaggagcactcgagagcacagcggccctgggctgcctggtcaaggactacttcctatatactgtctgagcgggctggcaaggcgcatag

SEQ ID NO: 792103 - DNA, 710 bp, Homo sapiens
  misc_feature: 44528.44.55.E11.1.pb.heavy.1.raw 44528
cgtatcgcctccctcgcgccatcagacagtatatacacgaccggtgctcgatttagcactcgcacgttggtttgggggggagaggagcccagcactgggattccgaggtgtttccattcggtgatcagcactgaacacagaggactcaccatggagttttggctgagctgggttctccttgttggacttttaaaaggtgtccagtgtgaggtggcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctcccaccaagggcccatcggtcttcccccctggcacccctcctccaagagcaccctctgggggcacagcggccctgggctgcctggtcaaggactacttcctatatactgtctgagcgggctggcaaggcgcatag

SEQ ID NO: 792104 - DNA, 647 bp, Homo sapiens
  misc_feature: 44558.UNK.UNK.UNK.pb.heavy.1.raw 44558
ctatgcgccttgccagcccgctcagacagtatataggaagtagtccttgaccaggcagcccagggccgctgtgctctcggaggtgctcctggagcagggcgccagggggaagaccgatgggcccttggtggaggctgatgagacggtgacctggattccctggccccagggttcgaagaagcccgtggtcattgtggtcatgaagtggcacagaaatatgtgcctgtgtccacaggtccacgttggtcaatgtaaggaccacctggtttttggacgtgtccttcgtgagcgtgagtctggtcgtcagagaaggactatatcgtatatcgtccattccaataagtgagtgcgatccactccaggcctttccggggggctgccgcacccagacaacgcctctccaggagtgacgagtgagaagcctgagacggtgcaggtcagcgtgaggtctgtgtgggtttcaccaatgtagggccagactctttcacggtgatctgggacaggccccatgaagggatggtcagcagcaggagcgtggagcaaagtgtgtccatggtggggcacaggagtccccttcccttcacactacactaaatcgagccaccggtcgtgtatatactgtctgatggcgcgagggaggcgatacg

SEQ ID NO: 792105 - DNA, 689 bp, Homo sapiens
  misc_feature: 44600.44.73.G07.1.pb.heavy.1.raw 44600
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgaagatgaatccagaggctgcacaggagagtctcagggagttccaggctgggccgctcctccccagactccactagctgcacctgacactggccacctcttaaaagagcaacgaggaaaacccatctcagcccaaagtccatggtgagtcctctgtgtcagtgatgatcaccgaatggaaacaccggcgacttccagtgctgggctcgtctcccccctgagcgtagagctaaatcgagcaccggtcgtgtatatactgtctgatggcgcgagggaggcgatacg

SEQ ID NO: 792106 - DNA, 690 bp, Homo sapiens
  misc_feature: 44606.44.78.H01.1.pb.heavy.1.raw 44606
cgtatcgcctccctcgcgccatcagacagtatatacacgaccggtgctcgatttagtgtgagtagttttgggttgggagctctggagaggagccccagccttgggattcccaggtgttttcattcagtgatcaggactgaacacagaggactcaccatggagtttgggctgagctggattttccttgctgctattttaaaaggtgtccagtgtgagggtgcagttggtggagtctggggaggtttggtaaagcctggggagtccttagactctcctgtgcagcctctggattcactttcagtaacgcctggaatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttcccccctggcgcctgctccaggagcacctccgagaagcacagcggcctgggctgcctggtcaaggactacttcctatatactgtctgagcgggctggcaaggcgcatag

SEQ ID NO: 792107 - DNA, 701 bp, Homo sapiens
  misc_feature: 44620.44.21.B10.1.pb.heavy.1.raw 44620
ctatgcgccttgccagcccgctcagacagtatataggaagtagtccttgacaggcagcccagggccgctgtgcccccagaggtgctcctggagcagggcgccagggggaagaccgatgggcccttgggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgaacggacccaggccaagtgataatcactaagactgaatcctgagactacacaggagagtctcagagacccggccctggctgtgccaagccccccccgactccgccagtcgcccctcgcactggacaccttctaaaaaaactacaaggaaaatcaagattagcccaaactccatgggttggtggttctgtgctcagtgctgatcaccaagtggaaactcctgggaatctcacggctggggctcctctctccttgcgacgacactaaatcgagcaccggtcgtgtatatactgtctgatggcgcgagggaggcgatacg

SEQ ID NO: 792108 - DNA, 738 bp, Homo sapiens
  misc_feature: 44635.UNK.UNK.UNK.pb.heavy.1.raw 44635
cgtatcgcctccctcgcgcccatcagacagtatatacacgaccggtgctcgatttagagtgaggctcgttgggtttggggctgggagaggagcccagcaccagaagtcggcggtgtttccagtcggtgatcagcaccgaacacagaggactcaccatggagtttgggctgactgggttttcctcgttgctcttttaaggaggtgtcccagtgtcaggtgaagcttggtggagtctgggggaggcgtggtccagccttgggaggtccctgagactctcctgtgtagcgtctggattcaccttcaacaagacatggcatgcactgggtcgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccggtctcctcagcctcccaccaacggggcccatcggtcttccccctggcacctcctccaagagcacctctggggcacagcggcctggggctgccctggtccaaggactacttcctatataactgtctgagcgggcctggcaaaggcgcatag

SEQ ID NO: 792109 - DNA, 665 bp, Homo sapiens
  misc_feature: 44660.44.12.B01.1.pb.heavy.1.raw 44660
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggagaagaaccacaggtgcttcatgttcttgcacaggaggtccatgactctcagaaaagcccccgcggaatctacactactaaatcgagcaccggtcgtgtatatactgtctgatggcgcgagggaggcgatacg

SEQ ID NO: 792110 - DNA, 646 bp, Homo sapiens
  misc_feature: 44681.UNK.UNK.UNK.pb.heavy.1.raw 44681
cgtatcgccctccttcgcgccatcagacatatacacgaccgtgctcgatttagtacacgtgattaggggattgggggcttctggagagtcaaggacctcctgttgcaagaacatgaagcaccctgtggttttcctcctgctggtggcagctcccagatgggtcctgtcccaggtgcagctgccaggagtcgggcccaggactggggaggccttcggaaccctgtctctcatctgcactgtctctggagtttccatcagttctgatcattcttggggctggatcggcagccccagggaggggaatgagtggattgggtgacatccattatactgggcgacgtacttactctccgtccgctcagagtcgtctcaccatttcgaggacacgtccatgaaccgcttctcctgaaactgacctccgtgacgccgcggagcccgtttatttctgtgcgaggcgagactgtcctttcaatctatgggccgtggcacgccctggtcactgtctcctcagcttccaccaagggcccatcggtcttccccctggcgccctgctccaggagcacctctgggggcacagcggcctgggctgcgctggtcaaggactactttcctatatactggtctgagcgggctggcaagggcatag

SEQ ID NO: 792111 - DNA, 691 bp, Homo sapiens
  misc_feature: 44693.44.27.C05.1.pb.heavy.1.raw 44693
ctatgcgccttgccagcccgctcagacagtatataggaagtagtccttgaccaggcagccaggccgctgtgctctcggaggtgctcctggagcagggcgccagggggaagaccgatggcccttggtggaggccgagagacggtgaccagggttccctggccccaggcgtcgaatgaaccgattttggaaacagatagtctcgcacaaaaatacacggccgtgtcctgaggtctcaggctgtttcatttgaagagacactgtgttctcggaattgtctctggagatggtgaatcggccctcaacggaatcaccgtagacttgatttcctccatgaaatgacacacctgccacccactccagccctcgcctggagcctggcggaccactgcatattcaattatcgaaggtgaatccagaggctgcacaggagagtctcagggacccccctactgggccacgcctccccagactccacgattgcacctgacacatgacacctctaagagggcaacgaggaaaacccagctcagcccaaactccatggtgagtcctctgtgttcagtgatgatcaccgagtggaaacacggcgacttccagtgctgggctcgtctccagcccaaacccttcgatcgcgtctaaatcgagcaccggtcgtgtatatactgtctgatggcgcgagggaggcgatacg

SEQ ID NO: 792112 - DNA, 598 bp, Homo sapiens
  misc_feature: 44743.UNK.UNK.UNK.pb.heavy.1.raw 44743
gaaggctgggcaggctatgcaccctggtccaggtcaaaagctgcggaaccgctagcggccatcttggccactaggggtccgcagattcatattgtcgtctagcatgcacaatgctgcaaacccagcttgcaatgcccacagcaagcggccaatctttacgccacgtgaattgtttattacctgtgactggctatggcttgcaacgcactcgtaaactagtactttgcggttagggaaagtagacaaacccattactcacttccggagttcaactcattccaacacgaaataaaagtaaactcaacaccccaagcaggctatgtgggggggtgatagggtggattctatttcctatcccatcccctaggatctcaattaagttactagcgagttaaatgtctgtagcgatcccgtcagtccttatcgcgcgcatcaagacctggttggttgagcgtgcagtagatcatcgataagctgcgagttaggtcatccagaccgcatctggcgcctaaacgttcagtggtagctaaggcgtcaccttcgactgtctaaaggcaatatgtcgtccttagctccaagtccctagcaagcgtgtcgg

SEQ ID NO: 792113 - DNA, 677 bp, Homo sapiens
  misc_feature: 44749.44.53.E09.1.pb.heavy.1.raw 44749
cgtatcgcctccctcgcgccatcagacagtatatacacgaccggtgctcgatttagagagagtgtgttgagctctgggagaggagccccagcctgggattcccaggtgtttcattcagtgatcaggactgaacacagaggactcaccatggagtttgggctgagctggattttccttgctgctattttaaaaggtgtccagtgtgaggtgcagttggtggagtctggggaggtttggtaaagcctgggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcgtcttcccctggcgccctgctccaggagcacctccgagagcacagcggccctgggctgcctggtcaaggactactttcctatatactgtctgagcgggctggcaaggcgcatag

SEQ ID NO: 792114 - DNA, 703 bp, Homo sapiens
  misc_feature: 44803.44.55.E11.1.pb.heavy.1.raw 44803
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtcagtgtgaggtgcggctgaggagtctggagggaggcttagtccagcctgggggggtccagagactctcctgtgcagcctctgggctcaccgtcagcagcaactacatgagttgggtcccgccaggctccagggaaggggctggagtgggtctcagtcatttatactggtgatttcacatactacgcagaactcgtgaagggccgatcaccatctccagggacaattccaggacacggttatcttcaaatgaacaacctgagaggcgacgacacggccgtctattactgtgcgagacaagtcggcgcttcggagtggttattattcgttttgacttctggggccagggaacctggtcaccgtcgcctccgcctccaccaggggcccatcggtcttccccctggcaccctcctccaagagcacctctgggggcacagcggccctgggctgcctggtcaaaggactacttcctatatactgtctgagcgggctggcagcgcatag

SEQ ID NO: 792115 - DNA, 626 bp, Homo sapiens
  misc_feature: 44804.UNK.UNK.UNK.pb.heavy.1.raw 44804
cgtatcgcctcctcgcgccatcagacagtatatacacgacgtgctcgatttagtacacgtgattagggattggggatgcttctgagagtcaaggaacctcctgtgcaagaacatgaagcacctgtggttttcctcctgctggtggcagctccagatgggtcctgtccagtgcagctgcaggagtcggccagactggtgaggccttcgggaaccctgtctctcatctgcactgtctctgagttccatcagttctgatcattcttgggctggatcggcagcccaggaggggaatggagtgattggtgacatccattatactggggcgacgtactactctcgcgtccctcaagagtcgtctcaccatttcgagggacacgcctcatgaccgcctctccctgaaactgactcgtgaccgccggacacgccgcgtttattctgtgcgaggcgagactggtctttcaatctatggggccgtgcggcacctggtcactgtctctcagcttccacaagggccagtcggtctcccctgcgcctgctccagagcacctctggggcacagcggccctggctgcctggtcaaggactacgtctcctacatacctgtctgagcggctgcaagcgcatag

SEQ ID NO: 792116 - DNA, 702 bp, Homo sapiens
  misc_feature: 44827.UNK.UNK.UNK.pb.heavy.1.raw 44827
ctatgcgccttgccagcccgctcagacagtatataggaagtagtccttgaccaggcagcccagggccgctgtgctctcggaggtgctcctggagcagggcgccaggggaagacgatgggcccttggtggaggctgaggagacggtgaccagggttccctggcccagtggacagttcctgatataaacacaacacaataatacatgcccgtgtcctcggtttttcaggttagtcattcgcagaatcaatgagttcttgaagtcatctctttgagagggtgaatctggctttcacagacgcggcgtactctgtgataaagctggcaactttgtttttacttgcggccaagccactccagccccttcctggagcctggcggacccagtccatatagtggtcactgatggtgaatccagaggcgacacaggagagtcttcagggaccctccaggctggaccaagtctcccccggactccaccactgcacttcactctggacaccttgtaaaataacaacaaggaaacccagctcagaccgaactccatggtgagtcctcagtgtcgtgctgatcaccaaatgaaaacacctgggaatttctggggctggggctccgctctcagagctccccaagagagatcgtgacgacagctaaatcgagcaccggtcgtgtatatacgtctgatggcgcgagggaggcgatacg

SEQ ID NO: 792117 - DNA, 700 bp, Homo sapiens
  misc_feature: 44839.44.70.G04.1.pb.heavy.1.raw 44839
ctatgcgccttgccagcccgcctcagacagtatataggaagtagtccttgaccagggcagcccagggcgctgtgctctcggaggtgctcctggagcagggcgccagggggaagaccgatggcccttggtggaggctgaggagacggtgaccagggtccctggccccagtcatgcgcccggtaataactactaccacctccgatctcgcacagtaatacagagccgagtcctcgactctcaggctgaccatttccaagtacacaatgttccgggaattgtctctggaggatggtgaatcggccttcacggagtctgcataatattcagaacttccatcatgtgctataactgccaacactccggcccctgcctggagcctggcggaccagtgcatgccagaacactgaaactaaatccagagcttcacaggagagtctcagggacctcccaggctggaccacgcctcgcccagactccaccaggtgcacctgacagtggacacctcttaaaagagcaacgaggaaaacccagctcagcccaaacctccatggtgagtcctctgtgttcagtgctggatcagcgaatggaaacaccgccgacttctagtggctggctcctctccagaccctttccttcacactacactaaatcgagcaccggtcgtgtaatactgtctgatggcgcgaggggaggcgatacg

SEQ ID NO: 792118 - DNA, 594 bp, Homo sapiens
  misc_feature: 44858.44.78.H01.1.pb.heavy.1.raw 44858
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgtcttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgagggccccaggcttcttcacctcagccccagactgcaccagctgtacctgggagtgggaccgtcagtcttcctcttccccccaaacccaaactactcacactaaatcgagcaccggtcgtgtatatactgtctgatggccgggagggaggcgatacg

SEQ ID NO: 792119 - DNA, 738 bp, Homo sapiens
  misc_feature: 44883.UNK.UNK.UNK.pb.heavy.1.raw 44883
ctatgcggccttgccagcccgctcaacagattatataggaaagtagtccttgaccaggcagcccagggccgctgtgccccagaggtgctcattggaggagggtgccaggggaagaccgatgggcccttggtggaggctgaggagacggcgaccgcttggtcccttggcccaggcgtccataccattggagtagagcatgtcatatctgtatccacgaagccccatctctcgcacgtagtagacagccgtgtcctcggctctcacgtattcaattcccagaatatagtgtgtttcttcgaattgtctctggagattgtgaatcggcccttcacggaatctacataataatttacttaactgccatcataccatatataattgcccacccactccagtccttgcctggagcctggcggacccagtgccatgccatgctgttgaaggtgaatccagacgctacacaggagagtctcagcagaccagctccaggctggacctacctcccagactaccaccagcttcacctgacactgacaacctcttaaaagagcaactagaaaaccagtcagcccaactccatggtgaaatactcgtctgttcgggtgctgatcaccgactggaaaccaccgccgacttctggtgctgggctcctctcccagagctcccaaaccaacagctcactctaatcgaccaccggtcgtgtatatactgtctgatggcgcgaggaagacggatacg

SEQ ID NO: 792120 - DNA, 691 bp, Homo sapiens
  misc_feature: 44884.UNK.UNK.UNK.pb.heavy.1.raw 44884
tatgcgccttgccagcccgctcagacagtatataggaagtagtccttgaccaggcagcccagggccgctgtgctctcggaggtgctctggagcagggcgccagggggaagaccgatgggcccttggtggaggcgaggagacggtgaccagggttccctggccccaggcgtcgaatgaaccgatttggaaacagatagtctcgcacaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcgacccactgcatattccaattatcgaaggtgaatccagaggctgcacaggagagtctcagggacccccctactggggccacgcctcccccagactccacgaatgcacctgacacatgatacctcttaagagggcaacgaggaaacccagccagcccaactccatgggagtcctctgtgttcagtgatgacaccgagtggaaacaccggcgacttccagtgctgggctcgtctccaggccccaaacccttcgatcgcgtctaaatcgagcaccggtctgttatatactgtctgaggcgcgagggaggcgatacg

SEQ ID NO: 792121 - DNA, 606 bp, Homo sapiens
  misc_feature: 44886.44.36.D03.1.pb.heavy.1.raw 44886
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 792122 - DNA, 606 bp, Homo sapiens
  misc_feature: 44895.44.36.D03.1.pb.heavy.1.raw 44895
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttcctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 792123 - DNA, 607 bp, Homo sapiens
  misc_feature: 44931.UNK.UNK.UNK.pb.heavy.1.raw 44931
gaaggctgggcaggctatgcaccctggtccaggtcaaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgatagggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccggcatctggcgcctaaacgttcagtggtagctaaggcgtcaccttcgactgtctaaaggcaatatgtcgtccttagctccaagtccctagcaagcgtgtcggg

SEQ ID NO: 792124 - DNA, 734 bp, Homo sapiens
  misc_feature: 44937.44.86.H09.1.pb.heavy.1.raw 44937
ctatgcgccttgccagcccgctcagacagtatataggaagtagtccttgaccaggcagcccagggccgctgtgcccccagaggtgctcttggaggagggtgccagggggaagaccgatggggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttggcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaaaccaggtcagcccaaactccatggtgagtcctctgtgttcggtgctgatcaccgactggaaacaccgccgaacttctggtgctgggctcctctcccagagctccccaacccaagtctatagcactaaatcgagcaccggtcgtgtatattactgtctgatggccgcgagggaggcgatacg

SEQ ID NO: 792125 - DNA, 730 bp, Homo sapiens
  misc_feature: 44981.44.33.C11.1.pb.heavy.1.raw 44981
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaaacagacatggcatgcactggtccgccaggctccaggcaagggactggagtgggtggcacttatatggtatgatggaagtaataaatattatgtagattccgtggaagggccgattcaccatctccagagacaattcgaagaacacactatatctggaaatgaatagcctgagagccgaggacacggctgtctactactgtgcgagagatggggctcgtggatacagatatgacatgctctactccaatggtatggaccgcctggggccaagggaccacggtcgccgtctccctcagcctccacaagggcccatcggtcttcccctggcaccctcctccaagagcacctctgggggcacagcggccctgggctgcctggtccaaggactacttcctatatactgtctgagcgggctgcaaggcgcatag

SEQ ID NO: 792126 - DNA, 601 bp, Homo sapiens
  misc_feature: 44985.UNK.UNK.UNK.pb.heavy.1.raw 44985
cccgacacgcttgctagggacttggagctaaggacgacatattgcctttagacagtcgaaggtgacgccttagctaccactgaacgtttaggcgccagatgcggtctgggatgactaaccgcagcttatcgatgatctactgacgctcaaccaaccaggtcttgatgcgcgcgatagactgacgggatcgctacagacatttactcgcctagtaactttaattgagatcctagggatgggataggaaatagaatccacccctatcaccccccacatagcctgcttgggtgttgagttactttttatttcgtgttggaatggagttgaacttccgggaagtggagtaaatgggtttgtctattcccctaaccgcaaagtactagttttacgagtggcgttgcaagccatagccagtcacaggtaataaacaattcaacgtggcgtaaagattggccgcttgctgtgggcattgcaagctgggttgcagcattgtgcatgctagacgacaatatgaatctgcgggacccctagtggccaagatggccgctagcggttccgcagcttttgacctggaccagggtgcatagcctgcccagccttc

SEQ ID NO: 792127 - DNA, 657 bp, Homo sapiens
  misc_feature: 45060.UNK.UNK.UNK.pb.heavy.1.raw 45060
cgtatcgcctccctcgcgccatcagacagtatatacacggaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactgggctggatccgccagcccccagggaagggctggagtggattgggagtatctattatagtggagcacctactacaacccgtccctcaagagtcgagtcaccatatcagtagacacgtcaagaaccagttctccctgaagctgagctctgtgacccgccgcggacacggccgtgtattactgtgcgagagtagggcagttcgtcaccaactactttgaccactggggccagggaaccctggtcaccgtctcctcagcctcaccaagggcccatcggtcttcccctgcaccctcctccaagagcacctctggggcacagcggccctgggctgcctggtcaaggactacttcctatatactgtctgagcggctggcaaggcgcatag

SEQ ID NO: 792128 - DNA, 704 bp, Homo sapiens
  misc_feature: 45067.UNK.UNK.UNK.pb.heavy.1.raw 45067
cgtatcgcctcctcgcggcgccatcagacagtaatataacgcaacggtggctcgattagctgcgtcacgattctctcttggggagctctgagagcggagccccagcccagaattcccagggtgttttatttggtgatcagcactgaccagaggactcacatggagttgggctgagctgggttttccttgttgttattttacaaggtgtccagagtggaagtgcagttggtggagtcgcgggagacttgtccagcctggagggtccctgagactctccttgtcgcctctggattcaccatcagtgaccactatatggactgggtcgcaggctccaggaagggcgctggagtggctggccggcagtaaaaacaaagttgccagctttatccacagagtacggcccgcgtctgtgaaagccagattcaccctctcaagagatgacttcaagaactcattgattctgcgaatgactaacctgaaaccgagggacacgggcatgtattattgtgttgtgtttatatcaggaactgtccactggggccagggaacccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792129 - DNA, 717 bp, Homo sapiens
  misc_feature: 45085.UNK.UNK.UNK.pb.heavy.1.raw 45085
ctatgcgccttgccagcccgccgctcagacagtatataggaagtagtccttgacaggcagcccagggcccgctgtgccccccagaggtgctcttggaggaggggtggccaggggaagaccgatgggccttggtggaggcggaggcgacggtggaccagggttccctggccccagaagtcaacgaataataaccactcccgagcggccgacttgtctcgcacagtaatagacgggcccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttcctggagcctggcggacccaactcatgtagttgctgctgacggtgagccaggagctgcacaggagagtctctggggaccccccagggctggactaagctcctccagactccatcagccgcacctcacactggacacctttttaaaagtccaacaaggagaacccagctcagccaaaactccatggtggagtcctctgtgttcagtgctgatcaccgaatggaaacacctcggaattcccagtgctgggctctctccccccaaacccaacgtggcgttgctaaatcgagcaccggtcgtgtatatactgtctggatggcgcggagggaggcgatacg

SEQ ID NO: 792130 - DNA, 705 bp, Homo sapiens
  misc_feature: 45149.44.55.E11.1.pb.heavy.1.raw 45149
ctatgcgcccttgccagcccgctcagacagtatataggaagtagtccttgaccaggcagcccagggccgctgtgcccccagaggtgctcttggaggagggtgccaggggaaagaccgatgggcccttggtggaggcggaggcgacggtgaccagggttcgcctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataatgactgagacccactccaggccccttccctggagcctggcggacccaactcatgtagttgctgctgacggtgagccagaggctgcacagagaggtctctggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgaggaggcgatacg

SEQ ID NO: 792131 - DNA, 735 bp, Homo sapiens
  misc_feature: 45184.44.85.H08.1.pb.heavy.1.raw 45184
cgttatcgcctccctcgcgccatcagacagtatatacacgaccggtgctcgatttagtatcactcagtcgcgggagctcttggagaggagcccagcactagaagtcggcggtggttttccattcggtgatcagcactgaacacagaggactcaccatggagttctgggcttgagctgggttttcctcgttgctctttttaaagaggtgtccagtgtcagtgcagctggtggagtctgggggaggcgtggtccagcctgggaggtccctgagactctccctgtgcagcgtctggattcaccttcaggtacctatggcatgcactgggtccgccaggctcaggcaaagggggctggagtgggtggcacttatatggtatgatgggaagtaataatactatgcagactccgtgaagggccgattcaccatctccagagacaattcgccaagaaccacgctgtatctgcaaatgaacagcctgagagccgaggacacggctgtgtattactgtgcgaggacatattgtagtactaccacctgctggactactactacggtatggacgtctggggccaagggaccacggtcaccgtctcctcagcctccaccaaggggcccatcggtcttccccctggcaccctcctccaagagcacctctgggggcacagcggccctgggctgcctggtcaaggactacttcctatatactgtctgagcgggctggcaaggcgcataga

SEQ ID NO: 792132 - DNA, 611 bp, Homo sapiens
  misc_feature: 45188.UNK.UNK.UNK.pb.heavy.1.raw 45188
ctatgcgccttgccagcccgctcagacagtatatagaagtagtccttgaccaggcagccagggccgctgtgcccccagaggtgctcctggagcagggcgccaggggaagacgatgggcccttggtggaagctgaggagacggtgaccgtgtcccttggcccagacgtccataccgtagtagtagtatgcaactcccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagaccccacaccagccccttccctggagctggcggacccagtgcatcagtagctactgaaggtgaatccagaggctgcacaggagagtctcagggaccccccagctgaactaagcctcccccggactccaccagctgcacctcacactggacaccttttaaaatagcaacaagggaaaacccagctatcagatactaatcgagcaccgggtcgtgtatatactgtctgatggcgcgagggaggcgatacg

SEQ ID NO: 792133 - DNA, 684 bp, Homo sapiens
  misc_feature: 45193.UNK.UNK.UNK.pb.heavy.1.raw 45193
cgtatcgcctcctccgcgccatcagacagtatatacacgacgcgtgctcgattagcactcgcacgttgtggtttggggggagaggagcccagcactgggattccgaggtgtttccattcggtgatcagcactgaacacagagactcaccatggagttttggcctgagctgggtttctccttgttggacttttaaaaggtgtccagtgtgaggtgcggctgatggagtctggaggaggcttagtccagccgtgggggtcccagagactctcctggcagcctctgggctcaccgtcagcagcaactacatgagttgggtccgccaggctccagggaagggctggagtgggtctcagtcatttatactggtgatttcacatactacgcagactccgtgaagggcgattcaccatctccaggacaattcaggaacacggtttatcttcaaatgaacaacctgagaggcgacgacacggccgtctattactggtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcg

SEQ ID NO: 792134 - DNA, 745 bp, Homo sapiens
  misc_feature: 45211.UNK.UNK.UNK.pb.heavy.1.raw 45211
ctatggcgccttgccagcccgctcagacagtatataggaagtagtccttgaccaggcagcccagggccgctgtgcccccagaggtgctcttggaggagggtgccaggggaagaccgatggggcccttggtggaggctgaggagacggtgacccgtggtcccttggccccagacgtccataccgtagtagtagtccccagcaggtggtagtactacaatatgtcctcgcacagtaatacacagcgccgtgtcctcgctctcaggctgttcattgcagatacacgcgtgttcttgcgaattgtctctggagatggtgaatcggcccccttcaccggagtctgcatagtatttattacttccatcatacccatataagtgccacccactccagccccttgcctggagcctggcggacccagtgcatgccataggtactgaaggtgaatccagacgctgcacaggagagtctcagggacctcccaggctggaccacgcctccccagactcccccccagctgcacctgacacctggacaccctcttaaaagagtaacggaggaaaacccagctcagcccaaactccatggtgagtcctctgtgttcagtgctgatcaccgaatggaaacaccgcccgagcttctagtgctggcccctctctcccagagctccccgcgactggagtgatactaatcggagcaccgtcgtcgtggtatatactgtctgatggcgccgagggaggcgatacgg

SEQ ID NO: 792135 - DNA, 441 bp, Homo sapiens
  misc_feature: 45221.UNK.UNK.UNK.pb.heavy.1.raw 45221
gagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792136 - DNA, 699 bp, Homo sapiens
  misc_feature: 45249.44.73.G07.1.pb.heavy.1.raw 45249
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggtttttcctcgttactcttttaagaggtgtccagtgtcaggtgcacctggtggagtctggggaggcgtggtccagcctgggaggtccctgagactctcctgtgaagcctctggatttagtttcagtagttctgcatgcactgggtccgccaggctccaggcaagggccggagtggttggcagttatagcatatgatggaacttctagatattatgcagactccgtgaaggccgattcaccatctcagagacaattccggaacactctgtacctggaaatgatcagcctgagaggcgaggactcggctctgtattactgtgcgagatcgggaagtggcagcagctattatcgggcgtttcactggggccagggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792137 - DNA, 704 bp, Homo sapiens
  misc_feature: 45253.44.72.G06.1.pb.heavy.1.raw 45253
cgtatcgcctccctcgcgccatcagacagtatatacacgaccggtgctcgatttagctacgactgcaaggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctggggaggcttggtccagcctggggggtccctgagactctcctgtgcagcctctggattcacctttagtagttattggatgaactgggtccgccaggctcccagggaaggggctggagtgggtggccatcatgaaagaaaagaatggaactgagacacactatggtggactctgtgaagggcccgattcaccatctccagagacaacgccaaagaaactcactgtatctgcaaatgaacagtctgagagtcgaggaacacggctgtgtaattattgtgcgggaggcgctgggtggctcattgactaactgggggtcagggaaccctggtcaccgtctcctcagcctccaccaagggcccatcggtcttccccctggcgccctgctccaggagcacctccgagagcacagcggccctgggctgcctggtcaaggactacttcctaatatactgtctgagcgggctggcaaggcgcatag

SEQ ID NO: 792138 - DNA, 661 bp, Homo sapiens
  misc_feature: 45256.44.12.B01.1.pb.heavy.1.raw 45256
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctggggcacagcggccctgggctgcctggtcaaggactacttcctatatactgtctgagcgggctggcaaggcgcata

SEQ ID NO: 792139 - DNA, 675 bp, Homo sapiens
  misc_feature: 45287.44.70.G04.1.pb.heavy.1.raw 45287
cgtatcgcctccctcgcgccatcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggtttttcctcgttgctcttttaagaggtgtccactgtcaggtgcacctggtggagtctggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactgggccaggggaccctggtcaccgtctcctcagcctccaccaagggcccatcggtcttccccctggcgccctgctccaggagcacctccgagagcacagcggccctgggctgcctggtcaaggactacttcctaa

SEQ ID NO: 792140 - DNA, 700 bp, Homo sapiens
  misc_feature: 45356.44.36.D03.1.pb.heavy.1.raw 45356
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagtttcgggctgagctgggttttccttgttgttattttacaaggtgtccagagtgaagtgcagttggtggagtccgggggagaacttggtccagcctggagggtccctgagactctcctgtgtcgcctctggattcaccatcagtgaccactatatggactgggtccgccaggctccagggaagggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactgggccagggaaccctggtcaccgtctcctcagcctccaccaagggccatcggtcttccccctgcgccctgctccaggagcacctccgagagcacagcggccctggctgcctggtcaaggactacttcctatatactgtctgagcgggctggcaaggcgcatag

SEQ ID NO: 792141 - DNA, 703 bp, Homo sapiens
  misc_feature: 45495.44.67.G01.1.pb.heavy.1.raw 45495
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccaggggttccctggcccagaagtcaaacgaataataaccactccgagcgccgacttgtctcgcacagtaatagacggccgtgtcgtcgccttcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacgtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtggctgatcaccgaatggaaacacctcggaatcccagtgctgggctcctctccccccaaacccaatatgtatactctaaatcgagcaccggtcgtgtatatactgtctgatggcgcgagggagcgatacg

SEQ ID NO: 792142 - DNA, 608 bp, Homo sapiens
  misc_feature: 45513.UNK.UNK.UNK.pb.heavy.1.raw 45513
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792143 - DNA, 595 bp, Homo sapiens
  misc_feature: 45516.UNK.UNK.UNK.pb.heavy.1.raw 45516
ccgacacgcttgctagggaccttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgaacggatcgctacagacatttaactcgctagtaactaattgagatcctaggggatggataggaaatagaatccacccctatcaccccccacatagcctgctgggtgttgagtttactttatttcgtgttggatgagttgaacttccgggaagtggagtaatgggtttgtctacttccctaaccgcaaagtactagttttacgagtggcgttgcaaagcatagccagtcacagtaataaacaattcaacgtggcgtaaagattggccgcttgctgtggcattgcaagctgggtttgcagcattgtgcatgctagacgacaatatgaatctgcggacccctagtgccaagatggccgctagcgggttcgcagcttttgacctggaccagggtgcatagcctgcccagccttc

SEQ ID NO: 792144 - DNA, 661 bp, Homo sapiens
  misc_feature: 45520.UNK.UNK.UNK.pb.heavy.1.raw 45520
cgtatcgccctccctcgcgccatcagaccagtatataccgacgcggtgccgcgattagtgagtcagtagggaagggctgggagaggagcccagcactagaagtcggcggtgtttccattcggtgatcagcactgaacacagaggactcaccatgggagttgggctgagctgggttttcctcggctttttaagaggtgtccgtgtcaggttcagctggtggagtctgggggaggcgtgtccagcctgggacgtccctgagactctcctgtgttgcgtccggactcagtttcgtgactctgccatgcacgggtccgccaggctccaggcagggcccggagtgggtggccagtccatctggtctgatgaagtaaagatactatggaaactccgtgagggccgattctccgtctccagagacaattccagaacaccgtgtatctacaaagaacaatttgagagccgagactcggctcgctctattatgtacgagcccatcgttctactgggccaggagccctggtcaccgtctcctccgcctccacagggcgccatcggtcttccccctggcgccctgctccagggagcacctccgagagccagcggccctgggctgcctggtcaaggactacttcctatatactgtctgagcggctgcaaggcg

SEQ ID NO: 792145 - DNA, 650 bp, Homo sapiens
  misc_feature: 45525.44.86.H09.1.pb.heavy.1.raw 45525
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaaggcccatcggtcttcccctggcgccctgctccaggagcacctctggggcacagcggccctgggctgcctggtcaaggactacttcctatatactgtctgagcgggctggcaaggcgcatag

SEQ ID NO: 792146 - DNA, 731 bp, Homo sapiens
  misc_feature: 45529.UNK.UNK.UNK.pb.heavy.1.raw 45529
ctatgcgccttgccagcccgctcagaccagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacgggaatctacataatatttattacttccatcataccatataagtgccacccactccagtccttgcctggagcctggcggacccagtgcatgccatgtctggttgaaggtgaatccagacgctacacaggagagtctcaggacctcccaggctggaccacgcctccccagactccaccagcttcacctgacactgacacctcttaaaagagcaacgaggaaaacccaggtcagcccaaactccatggtgagtcctctgtgttcgggtgctgatcaccgactggaaacaccgccgacttctggtgctgggctcctctcccagagctcgccaaacccaacgagcctcactctaaatcgagcaccggtcgtgtatatactgtctgatggccgcgagggaggcgatacg

SEQ ID NO: 792147 - DNA, 728 bp, Homo sapiens
  misc_feature: 45535.44.56.F01.1.pb.heavy.1.raw 45535
cgtatcggcctccctcgcgccatcagacagtatatacacgaccggtgctcgatttagcagacgtctgaacacacaaagggctgggagaggagccccagcccgtgagattccaggagtttccacttggtgatcagcactgagcacagaccacccaaccatggcagtttgggctaatcttgattttccttgtagtttttttagaaggtgtccagtgcgaggggcgactggcggagtcggggggggcttggcacagccagggcgcggtctctgagactctcctgtgtagtctcaggattcagtcttagtgattatcacttggcctgggtccgtcagggccccagggaaggggcttgagtggattcactttcgtcagaatgaaacgttatgggtgaagtaagagtacgcccgcgtctgtgaagggaagattcaccgtctcaagggatgactccaacagtgttggccatttacaatgagcaacctgaggacccgacgacacaggcgtctattactgcgccaggcgcgatcctggggacgtcgatgcatttgatatttggggccaggggacaatggtcaccgtctctcttcagcttccaccaagggcccatcggtcttccccctggcgccctgctccaggagcacctctgggggcacagcggccctgggctgcggcctcgttcaaggactacttcctatatactgtgctgagccgggctggcaaggcgcatagg

SEQ ID NO: 792148 - DNA, 656 bp, Homo sapiens
  misc_feature: 45545.44.23.C01.1.pb.heavy.1.raw 45545
ctatgcgccttgccagcccgctcagacagtatataggaagtagtccttgaccaggcagcccagggccgctgtgccccccagaggtgctcctggagcagggcgccagggggaagaccgatgggcccttggtggaagctgaggagacagtgaccagggtgccacgggccccatagattgaaagaccagtctcgcctcgcacagaaataaacggccgtgtccgcggcggtcacggaggtcagttttcaggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttctttgcacaggaggtccttgactctcagaaagcccccaatccctaatcacgtgtactaaatcgagcaccggtcgtgtatatactgtctgatggcgcgagggaggcgatacg

SEQ ID NO: 792149 - DNA, 653 bp, Homo sapiens
  misc_feature: 45554.UNK.UNK.UNK.pb.heavy.1.raw 45554
cggtatcgcctccctcgcgccatcagtctatactatcacgacccggtgctcgatttagtgctatagacttgggtttggggatgctttctgagagtcaaggacctcctgtgcccaagaacatgaagcacctgtggtttttcctcctgctgggtggcagctcccgatgggtccctgtcccaggtgcagctgcaggagtcgggccaggactggtgagcccttcgggaaccctggtctcatctgcactgtctctggagttttccatcagttctgatcatcttggggctggatccggcagccccagggagggaatggagtggattggtgacatccattatactggggcgacgtactactctccgtcctcaagagtcgtctcaccatttcgaggcgcacgtccatgaaccgcttctccctgaaactgacctccgtgacgccgcggacacggcccgtttatttctgtgcgaggcgagactggtctttcaatctatggggccgtggcacccgggtcactgtctcctcagcttccaccaagggcccatcgtcttcccctggcgcccctgctccaggagcacctctggggcacagcggccctggcctgcctggtcaaggactacttcctatatactgtctgagcgggctggcaaggcgcatag

SEQ ID NO: 792150 - DNA, 683 bp, Homo sapiens
  misc_feature: 45593.44.45.E01.1.pb.heavy.1.raw 45593
cgtatcgcctccctcgccgccatcagaacagtatatacacgaccggtgctcgatttagtgagtcagtaagggaaaggggctgggagaggagcccagcactagaagtcggcggtgtttccattcggtgatcagcactgaacacagaggactcaccatggagttttggctgagctgggttttcctcgttgctcttttaagaggtgtccagtgtcaggtttcaagctggtggagtctgggggaggcgtggtccagcctggacgtccctgagactctcctgtgttgcgtccggactcagtttcagtgactctgccatgcactgggtccgccaggctccaggcaaggggctggagtgggtggcagtcatctggtctgatggaagtaaagaatactatgaaactccgtgaagggccgattctccgtctccagagacaattccaagaacaccgtgtatctacaaatgaacaatttgagagccgaggactcggctctctattatgtacgagcccatcgttctactggggccagggagccctggtcaccgtctcctcagcctccaccaagggcccatcggtcttccccctggcgccctgcttccaggagcactccgaggcacagcggccctgggctgcctggtcaaggactacttcctatatactgtctgagcgggctggcaaggcgcatag

SEQ ID NO: 792151 - DNA, 694 bp, Homo sapiens
  misc_feature: 45601.UNK.UNK.UNK.pb.heavy.1.raw 45601
ctatgcgccttgccagcccgctcagacagtattaggaagtagtccttgaccaggcagcccagggccgctgtgccccagaggtggctcctggagcaggcgccaggggaagaccgatgggcccttggtggaagctgaggtgacaatgaccagggttccctgcccccagatctcaaaggctccatgcgagctgggggtacggacctctcgcacaggtagtagacggccgtgtcgtcggatttcaaagaactcattgtcatggagactgtgtctgtggacttgtccgcggtaatcgtaattctgccccggaagtctcgtgccgtaggtgagtgagccaaaaagagggatgattccacccatccactcaagccttgtccagggggcctggcgcacccagttgatggtataagtagtggaactggtagtacttccagaggccgtgcaggaaagggtcaccgaggaccaaggttgcggcattctagtccagactgccaccagttgcaccagggactggacacctgttgctgctgccaccacaaagaggaacctccaggtccagtccatggtgatgagctgtgctcccagggcttctttagaggaggaatgtggttgttatgtgatgctccccctgatagagcctactaaatcgagcacggtcgtgtatatactgtctgatggcgccgagggaggcgatacg

SEQ ID NO: 792152 - DNA, 606 bp, Homo sapiens
  misc_feature: 45602.UNK.UNK.UNK.pb.heavy.1.raw 45602
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccaccctatcacccccccacatagcctgcttgggtgttgagttacttttatttcgtgttggaatgagttgaacttcgggaagtggagtaatgggtttgtctacttcccctaaccgcaaagtactagtttacgagtggcgttgcaagccatagccagtcacaggtaaataaacaattcaacgtggcgtaaagattggccgcttgctgtgggcattgcaagcctgggtttgcagcattgtgcatgctagacgacaatatgaatctgccgggacccctagtggccaagatggccgctagcgggttcgcgcagcttttgacctggaccagggtgcatagcctgccagccttc

SEQ ID NO: 792153 - DNA, 700 bp, Homo sapiens
  misc_feature: 45615.44.62.F07.1.pb.heavy.1.raw 45615
ctatgcgccttgccagcccgctcagacagtatataggaagtagtccttgaccaggcagcccagggccgctgtgctctcggaggtgctcctgagcagggcgccaggggaagaccgatggcccttggtggaggctgaagagacggtcaccactgtccccggcccaagtactaaaggtgtcatgggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactcagtcccctccctggagcccggcggacccaggtcatgccataggcactaaaggtgaatccagaggccgcacaggagagggtcagggacctcccaggccgaatcaggccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctgggctcctctctcagagctcccctttcctttatgcgactactaatcgagcaccggtcgtgtatatactgtctgatggcgcgaggaggcgatacg

SEQ ID NO: 792154 - DNA, 707 bp, Homo sapiens
  misc_feature: 45628.44.36.D03.1.pb.heavy.1.raw 45628
ctatgcgccttgccagccccgctcagacagtatataggaagtagtccttgaccaggcagcccagggccgctgtgctctcggaggtgctcctggagcagggcgccagggggaagaccgatgggcccttggtggaggctgaggagaacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaactttgtttttacttgcggccaagccactccagccccttcctggagcctggcggaccccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcacccaaatgaaaacacctgggaattctggggctggggctccgctctcagagcctccccagagagatcgtgacgcagctaaatcgagcaccggtcgtgtatatactgtctgatggcgcgagcgaggcgatacg

SEQ ID NO: 792155 - DNA, 672 bp, Homo sapiens
  misc_feature: 45634.44.35.D02.1.pb.heavy.1.raw 45634
cgtatcgcctccctcgcgccatcagacagtatatacacgaccggtgctcgatttagcacacgatagttgggtttgggatactttctgagactcatggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaacccgccctcaagagtcgagtcaccatgtcactagacaggtccaagaaccagttctccctgaaattgacttctgtgaccgccgcgacacggccgtatattattgtgcgagagattcctatcgatacagtagagacgggggggcgaactggctcgacccctggggccaggaaccctggtcaccgtctcctcagcctccaccaagggcccatcggtcttccccctggcaccctcctccaagagcacctctggggcacagcggcctgggctgcctggtcaaggactacttcctatatactgtctgagcgggctggcaaggcgcatag

SEQ ID NO: 792156 - DNA, 698 bp, Homo sapiens
  misc_feature: 45651.44.55.E11.1.pb.heavy.1.raw 45651
cgtatcgcctccctcgcgccatcagacagtatatacacgaccggtgctcgatttagcactcgcacgttgggtttggggggagaggagcccagcactggattccgaggtgtttccattcggtgatcagcactgaacacagaggactcaccatggagttttggctgagctggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtccgccaggctccaggaaggggctggagtgggtctcagtcatttatactggtgatttcacatactacgcagactccgtgaagggccgattcaccatctccaggacaattccaggaacacggtttatcttcaaatgaacaacctgagaggcgacgacacggccgtctattactgtgcgagacagtcggcgctcggagtggtttattattcgtttgacttctggggccagggaaccctggtcaccgtcgcctccgcctccaccaagggcccatcggtcttcccctggcaccctcctcaagagcacctctgggggcacagcggccctgggctgcctggtcaaggactacttcctatatactgtctgagcgggctggcaaggcgcatag

SEQ ID NO: 792157 - DNA, 578 bp, Homo sapiens
  misc_feature: 45713.44.78.H01.1.pb.heavy.1.raw 45713
ctatggcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgcctcctggtcatactaactctgccttggaaacttctgggcaaagcccgtgttgccactatagggcttcatccatcccatccactccagcccttgtccagcggcctgtcgcacccagttaatatcataattgatgaacgtgtattccagaagccgtgcaggagactgtcactgaggcccccaggcttcttcacctcagcagcgtggtgaccgtgacctccagccaacttcggcacccaaacccaaactactcacactaaatcgagcaccggtcgtgttatatactgtctgatgcgcgagggaggcgatacg

SEQ ID NO: 792158 - DNA, 700 bp, Homo sapiens
  misc_feature: 45750.44.33.C11.1.pb.heavy.1.raw 45750
cgtatcgcctccctcgcgcatcagacagtatatacacgaccggtgctcgatttagagtgagctcgttgggtttgggctgggagaggagcccagcaccagaagtcggcggtgtttcagtcggtgatcagcaccgaacacagaggactcaccatgagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactggtccgccaggctccaggcaagggactggagtgggtggcacttatatggtatgatggaagtaataaatatatgtagattccgtgaagggccgattcaccatctccagagacaattcgaaagaacacactatatctggaaatgaatagcctgagagccgagacacgctgtctactactgtgcgagagatgggggtcgtggatacagatatgacatgctctactccaatgtatggacgcctgggccagggaccacggtcgccgtctctcagcctccaccaaggcccatcggtcttcccctggcaccctcctccaagagcacctctgggggcacagcggccctggctgcctggtcaaggactacttcctatatactgtctgagcggctggc

SEQ ID NO: 792159 - DNA, 707 bp, Homo sapiens
  misc_feature: 45770.44.27.C05.1.pb.heavy.1.raw 45770
cgtatcgcctccctcgcgccatcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgaggctgggtttcctcgttgccctcttaagaggtgtcatgtgtcaggtgcaattcgtggagtcctgggggcagcgtggccccagtaggggggtccctgagacttctcctgtgcagcctctgaattcaccttcgataatggaatatgcagtgggtccgccaggctccaggcgaggggctggagtgggtggcaggtgtgtcatttcatggaggaaatcaagtctacggtgattccgttgagggccgaattcaccatctccagagacaattccgagaacacagtgtctcttcaaatgaacagcctgagacctcaggacacggccgtgtatttttgtgcgagactatctgtttccaaaatcggttcattcgacgcctggggggccagggaaccctggtcaccgtctcctcggcctccaccaagggcccatcgtcttcccctggcgccctgctccaggagcacctccgagagcacagcggccctgggcctgcctggtcaaggactactttcctatatactgtctgagcgggctggcaaggcgcatag

SEQ ID NO: 792160 - DNA, 651 bp, Homo sapiens
  misc_feature: 45771.44.23.C01.1.pb.heavy.1.raw 45771
cgtatcgcctccctcgcgccatcagacagtatatacacgaccggtgctcgatttagtacacgtgattagggattggggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgcatcattcttggggctggatccggcagcccccagggaggggaatggagtggattggtgacatccattatactggggcgaacgtactacctctccgtcctcaagagtcgtctcaccatttcgaggacacgtccatgaaccgcttctccctgaaactgacctccgtgaccgccgcggacacggccgttatttctgtgcgaggcgagactggtcttcaatctatggggccgtggcaccctggtcactgtctcctcagcttccaccaagggcccatcggtcttccccctggcgccctgctccaggagcacctctgggggcacagcggcctgggctgcctgtcaaggactacttcctatatactgtctgagcgggctggcaaggcgcatag

SEQ ID NO: 792161 - DNA, 681 bp, Homo sapiens
  misc_feature: 45791.44.36.D03.1.pb.heavy.1.raw 45791
cgtatcgcctcctcgcgccatcagacagtatatacacgaccggtgctcgatttagctgcgtcacgatctctcttggggagctctgagagcggagcccagccccagaattccaggtgttttcattggtgatcagcactgaacacagaggactcaccatggagttcggctgagctgggttttccttgttgttattttacaaggtgtcagagtgaagtgcagttgtggagtcggggagacttggtccagcctggagggtccctgagactctctgtgtcgctctggattcaccatcagtgaccactatatggactgggtccgccaggctccaggaaggggctggagtggcttggcgcagtaaaaacaaagttgccagctttatcacagagtacgccgcgtctgtgaaagccagattcacccctcaagagatgacttcaagaaacattgattctgcgaatgactaacctgaaaaccgaggacacggcatgtattattgtgttgtgtttatatcagaactgtccactggggccagggaaccctggtcaccgtctctcagcctccaccaagggcccatcgtcttcccctggcgccctgctcagagcacctccgagagcacagcggcctggcctgctggtcaaggactacttcctatatactgtctgagcgggctggcaaggcgcatag

SEQ ID NO: 792162 - DNA, 706 bp, Homo sapiens
  misc_feature: 45792.44.27.C05.1.pb.heavy.1.raw 45792
cgtatcgcctccctcgcgccatcagacagtatatacacgaccggtgctcgatttagacgcgatcgaaggtttggggcctgggagacgagcccagcactgaagtcgccggtgtttccactcggtgatcatcactgaacacagaggactcaccatggagtttggctgagctgggttttctcgttgccctcttaagaggtgtcatgtgtcaggtgcaattcgtggagtctggggggaggcgtggcccccagtaggggggtcctgagactctccgtgtgcagcctctggattcaccttcgataattggaatatgcagtggtccgccggaggctccaggcgaggggctggagtggtggccaggtgtgtcatttcatggaggaaatcaagtctacggtgattccgttgagggccggattcaccatctcagagacaattccgagaacacagtgtctcttcaaatgaacagcctgagacctcaggacacggcccgtgtatttttgtgcgagactatctgtttccaaaatcggttcattcgacgcctgggccagggaaccctggtcaccgtctcctcggcctccaccaagggcccatcggtcttccccctgggcgccctgctccaggagcacctccgagagcacagcggccctgggctgcctggtcaaaggactacttcctatatactgtctgagcgggctggcaaggcgcatag

SEQ ID NO: 792163 - DNA, 695 bp, Homo sapiens
  misc_feature: 45793.44.73.G07.1.pb.heavy.1.raw 45793
ctatgcgccttgccagccgctcagacagtatataggaagtagtccttgaccaggcagcccagggccgctgtgctctcggaggtgctcctggagcagggcgccaggggaagaccgatgggccccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgtttcttcaattccatctttctgatataattgccacccactccagccccttgcctggagcctggcggaccagtgcatggcataggtcctgaagatgaatccagaggctgcacaggagagtctcagggagttcccaggcctgggccgctcctcccccagactccactagctgcacctgacactggccacctcttaaaagagcaacgaggaaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatacg

SEQ ID NO: 792164 - DNA, 658 bp, Homo sapiens
  misc_feature: 45817.44.53.E09.1.pb.heavy.1.raw 45817
cgtatcgccctccctcgccgccatcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccccaggagaggggctgcagtggattgggagtctctattatagtgggaacacctactacaacccgtccctcaacggtcgagtcaccatatccgtggacacgtcgaggacacagtattccctgaaagtgagtctgtggccgccgccgacacggctgtctactactgtgtcagacatgggtccgcctatggccaggtcgtctcaattctactacgcttgggaacgtctggggccaaggaccacggtccaccgtctcctcatcctcagcctccaccaagggcccatcggtcttcccctggcgccctgctccaggagcacctccgagagcacagcggcctgggctgcctggtcaaggactactttcctatatactgtctgagcgggctggcaaggcgcatag

SEQ ID NO: 792165 - DNA, 719 bp, Homo sapiens
  misc_feature: 45829.44.85.H08.1.pb.heavy.1.raw 45829
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatgtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggatactactacggtatggacgtctggggccaagggaccacggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 792166 - DNA, 599 bp, Homo sapiens
  misc_feature: 45842.44.36.D03.1.pb.heavy.1.raw 45842
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccaggaaggccctggagtggcttgcacacatcttctcgaatgacgaaaaatcctacagtacatctctgagagcagtttaaccatctccaaggacacctccaaaaggcaggtggtctttagtatgaccaacatggaccctgcgacacaggcacatatactgtgcacgggtaatgcgggaaagaaacagctggtttctgtattataagtcttaccatctggacgtctggggcaaagggaccacggtcaccgtctcctcagcttccaccaagggcccatcggtcttcccctgcgccctgctccaggagcacctctggggcacagcggccctgggctgcctggtcaagactacttcctatatactgtctgagcgggctgcaaggcgcatag

SEQ ID NO: 792167 - DNA, 588 bp, Homo sapiens
  misc_feature: 45858.UNK.UNK.UNK.pb.heavy.1.raw 45858
ccgacacgcttgctaggacttggagctaaggacgacatattgcctttagacagtcgaaggtgacgccttagctaccactgacgtttaggcgccagatgccgtctgggatgacctaactcgcagctatcgatgatctactgcacgctcaaccaaccaggtcttgatgcgcgcgataggactgacgggatcgctacagacatttaactcgctgtaacttaatgagatcctaggggatgggataggaaatagaatccacccctatcacccccccacatagcctgcttgggtgttgagtttacttttattcgtgttggaatgagttgaacttccggaagtggagtaatggtttgtctacttcccctaaccgcaagtactagttttacgagtggcgttgcaagccatagccagtcacaggtaataaacaattcacgtgcgtaagattggcgcttgctgtgggcattgcaagctggtttgcagcattgtgcatgctagacgacaatatgaatctgcgggacccctagtggccaagatggcgctagcgggttccgcagcttttgacctggaccagggtgcatagcctgcccagct

SEQ ID NO: 792168 - DNA, 692 bp, Homo sapiens
  misc_feature: 45991.UNK.UNK.UNK.pb.heavy.1.raw 45991
ctatgcgccttgccagcccgctcagacagtatataggaagtagtccttgacagcagccggccgctgtgctctcgaggtgctcctggagcagggcgccaggggaagaccgatgggcccgcgtgaggctgagggacggggaccaggggcgcctggccccagtcatgcgcccggtaataatactaccacctcccgatctgcacagtatacagagccgagtcctcgactctcaggctgaccatttccaagtacacaatgttccgggaaattgtctctggagatggtgaatcggcccttcacggagtctgcataatattcagaacttccatcatgtgctataactgccaaccactccggcccttgcctgggcctggcggacccagtgcatgccagaaccactgaaactaaatccagaggcttcacaggagagtctcagggacctccaggctggaccacgcctcgccccagactccacaggtgcacctgacagtggacacctcttaaaagagcaacgaggaaaacccagctcagcccaaactccatggtgagtcctctgtgttcagtgctgatcaccgaatggaaacaccgccgacttctagtgctgggctcctctccagaccccttcccttcacactacactaaatcgagcacggtcgtgtatatactgtctgatggcgcgaggggaggccgatacg

SEQ ID NO: 792169 - DNA, 643 bp, Homo sapiens
  misc_feature: 46075.UNK.UNK.UNK.pb.heavy.1.raw 46075
cgtatcgcctccctccgccatcagacagtatgatacacgacggtgctcgattagagagagtgtgttgcggttggaggaagccctgtggtcttcctctgctggtggcggctccaggatgggtcctgtctcagccgcagctgccgagtcgggcccaggactgcgtgaagccttcggagaccctgtccctcagtggcacggtctctgggcctccatcgacagaagtaatttctactggggctggatcgccagccccagggagaggggctgcagtggatgggagtctctattatagtgggaaccacctactacaacccgtccctcaacggtcgagtcaccatatccgtggacacgtcgaggacacagttttcctgaagtgagtttctgtggccgccgccgacacggctgtctaactactgtgtcagacatgggtccgcctatggcaggtcgtctcaattctactacgccttgggacgtctggggccaagggaccaggtcaccgtctcctcatcctcagcctcaccaaggcccatcggtcttcccccctggcgccctgctcaggagcacctccgagagcacagcggcctgggctgcctggtcaaggactactcctatatactgtctgagcgggctggcaggcgcatag

SEQ ID NO: 792170 - DNA, 668 bp, Homo sapiens
  misc_feature: 46097.44.12.B01.1.pb.heavy.1.raw 46097
cgtatcgcctccctcgcgccatcagacagtatatacacgaccggtgctcgatttagtagtgtagatccgcgggggctttctgagagtcatggacctcctgtgcaagaacatgaagcacctgtggttcttcctcctgctggtggcggctccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggggctggagtggattgggagtatctattatagtggcgagcacctactacaacccgtccctcaagagtcgagtcaccatatcagtagacaccgtccaagaaccagttctccctgaagctgagctctgtgaccgccgcgggaccacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctggggcacagcggcccctgggctgcctggtcaaggactacttcctatatactgtctgagcgggctggcaaggcgcatag

SEQ ID NO: 792171 - DNA, 681 bp, Homo sapiens
  misc_feature: 46119.44.53.E09.1.pb.heavy.1.raw 46119
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaaggggactcccaggctttaccaaacctccccagactccaccaactgcacctcacactggacaccttttaaatagcagcaaggaaaatccagctcagcccaaactccatggtgagtcctctgtgttcagtcctgatcactgaatgaaaacacctgggaatcccaaggctggggctcctctcccagagctcaacacactctctctaaatcgagcaccggtcgtgtatatactgtctgatggcgcgagggaggcgatacg

SEQ ID NO: 792172 - DNA, 706 bp, Homo sapiens
  misc_feature: 46125.44.55.E11.1.pb.heavy.1.raw 46125
cgtatcgcctccctcgcgccatcagacagtaatacccacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatgagtctggaggaggcttagtccagcctgggggtcccagagactctcctgtgcagcctctgggctcaccgtcagcagcaactacatgagttggggtccgccaggctccagggaagggggctggagtgggtctcagtcatttatactggtgatttcacatactacgcagactccgtgaagggccgattccaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcggtcttccccctggcaccctcctccaagagcacctctgggggcacagcggccctggctgcctggtccaaggactacttcctatatactgtctgagcgggctggcaaggcgcatag

SEQ ID NO: 792173 - DNA, 617 bp, Homo sapiens
  misc_feature: 46138.44.23.C01.1.pb.heavy.1.raw 46138
cgtatcgcctcctcgcgccatcagacagtatatacacgaccggtgctcgatttagtacacgtgattagggattggggcagggtgaacactgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttccccctggcgccctgctccaggagcacctctgggggcacagcggccctgggctggcctggtcaaggactacttcctatatactgtctgagcgggctggcaaggcgcatag

SEQ ID NO: 792174 - DNA, 707 bp, Homo sapiens
  misc_feature: 46143.UNK.UNK.UNK.pb.heavy.1.raw 46143
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccaggggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggaccccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacggcagctaaatcgagcaccggtcgtgtatatactgtctgatggcgcgagggaggcgatacg

SEQ ID NO: 792175 - DNA, 592 bp, Homo sapiens
  misc_feature: 46153.44.78.H01.1.pb.heavy.1.raw 46153
cgtatcgcctccctcgcgccatcagacagtatatacacgaccggtgctcgatttagtgtgagtagtttgggttggggggaagaggaagactgaggtcccactcccaggtacagctggtgcagtctgggctgaggtgaagaagcctggggccctcagtgacagtctcctgcacggcttctggatacccgtcatcaattatgatattaactgggtgcgaccaggccgctggacaagggctggagtggatgggatggatggaagccctatagtggcaacacgggctttgcccagaagttccaaggcagagttagtatgaccaggagcacctcccccaggtacagtctacatggaactgagcagcctgagatctgaggacacggccgtgtatttctgtgcgagagccaccagcacctggcttgacttgtggggccagggaaacctggtcaccgtcttcctcagcctccaccaaggcccatcggtcttccccctggcgccctgctccagggagcacctccgagagcacagcagccctgggctgcctggtcaagactacttcctatatactgtctgagcgggctggcaaggcgcatag

SEQ ID NO: 792176 - DNA, 719 bp, Homo sapiens
  misc_feature: 46160.UNK.UNK.UNK.pb.heavy.1.raw 46160
cgtatcgcctcccctggcgccatcagcacagtatatacacgaccggtgcttcgatttagcactcgcacgttgggtttggggggggagaggagccccagcactgggattccgaggtgtttccattcggtgatcagcactgaacacagaggactcaccatggagttttgggctgagctgggttctccttgttggacttttaaaaggtgtccagtgtgaggtgcggcctgatggagttctggaggaggcttagtccagcctggggtcccagccagactctcctgtgcagcctctgggctcaccgtcagccagcaactacatgagttgggtccgccaggctccagggaaggggctggagtggggtctcagtcatttgatactggtgatttcacatactacgccagactccgtgagagggccgattcaccatctccagggacagattccaggaacacggtttatcttcaaatgaacaacctgagagggcgacgacacggccgtctattactgtgcgagacaagtcggcgctcggagtggttattattcgtttgacttctggggccagggaaccctggtcaccgtcgcctccgcctccaccaagggccatcggtcttccccctggcaccctcctccaagagcacctctgggggcacagcggccctggctgcctggtcaaggactacttcctatatactgtctgagcgggctggcaaggcgcatag

SEQ ID NO: 792177 - DNA, 672 bp, Homo sapiens
  misc_feature: 46167.44.6.A06.1.pb.heavy.1.raw 46167
ctatgcgccttgccagcccgctcagacagtatataggaagtagtccttgaccaggcagcccagggccgctgtgcccccagaggtgctcctggagcaggggcccagggggaagaccgatgggcccttggtggaagctgaggtgacaatgaccagggttccctgccccagatctcaaaggctccatgcgagctgggtacggacctctcgcacagtagtagacggccgtgtcgtcggatttcaaagaactcattgtcatggagactgtgtctgtggacttgtccgcggtaatcgtaattctgcccggaagtctccgtgcgtaggtgagtgagccaaaagagggatgattccacccatccactcagcccttgtccaggggcctggcgcacccagttgatggtataagtagtggaactggtagtacttccaagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 792178 - DNA, 703 bp, Homo sapiens
  misc_feature: 46170.44.36.D03.1.pb.heavy.1.raw 46170
cgtatcgcctccctcgcgccatcagacagtatatacacgaccggtgctcgatttagctgcgtcacgatctctcttggggagctctgagagcggagccccagcccagaattccaggtgttttcatttggtgatcagcactgaacacagaggactcaccatggagttcggctgagctgggttttccttgttgttattttacaaggtggttcagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgctggtcaagggactacttcctatatactgtctgagcgggctggcaaggcgcatag

SEQ ID NO: 792179 - DNA, 699 bp, Homo sapiens
  misc_feature: 46185.44.62.F07.1.pb.heavy.1.raw 46185
ctatgcgccttgccagcccgctcagacagtatataggaagtagtccttgaccaggcagcccagggccgctgtgctctcggaggtgctcctggagcagggcgccaggggaagacgatgggcccttggtggaggctgaagagacgtcaccactgtcccccggccccaagtactaaaggtgtcatggggggtcaccgtggtcctggctttcaacagtaatagacgcctgtgtcctcgggtctcaggtttttcatttggagaaacaatttgtcctgcgattgtcctggaaatggtgaagcggcccttcacggagtctccgtagaaagtgacaccccagctccgatacttgagacccactccagtcccctccctggagcccggcggaccaggtcatgccataggcactaaaggtgaatccagaggccgcacaggagagggtcagggacctcccaggccgaatcaggcccccccagactccaacaactgcacttcacacacgacaccttaaaaaagccacaagaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatgcgcgagggaggcgatacg

SEQ ID NO: 792180 - DNA, 695 bp, Homo sapiens
  misc_feature: 46198.UNK.UNK.UNK.pb.heavy.1.raw 46198
ctatgcgccttgccagcccgctcagaagtatataggaagtagtccttgaccaggcagcccagggccgctgtgcccccagaggtggctcctggagcgggcgccagggggaagaccgatgggcccttggtggaagcctgagtgacaatgaccagggttccctgcccccagatctcaaaggctccatgcgagctggggtacggacctctcgcacagtagtagacggccggtgtcgtcggatttcaaagaactcattgtcatgggagactggtgtctgtggacttgtccgcggtaatcgtaatttctgccccgaagtctcgtggcgtaggtgagtgaggccaaaaacgagggatgattccacccatccactcaaagccttgtctcagggcctggcgcacccagtgatggtattaagtaggtgaactggtagtacttccagaggcccgtgcaggaaagggtcacgcgagggaccaagcgttggcggcaattctagtcccagactgcaccagttgcaccagggactggacacctgttgctgctgcgcaccacaaagaggaacctccaggtccagtccatgggtgatgagctgtgctcccaggggcttcttttagaggaggaatgtggctgttgtcagtagatctaaattcgagcaccggtcgtgggtatatactgtctgatggcgcgagggaggcgatacg

SEQ ID NO: 792181 - DNA, 702 bp, Homo sapiens
  misc_feature: 46209.UNK.UNK.UNK.pb.heavy.1.raw 46209
cgtatcgcctccctcgcgccatcagacagtatatacaaccggtgctcgatttagctgcgtcacgatctctcttggggagctctgagagcggagccccagccccagaattcccaggtgttttcatttggtgatcagcactgaacacagagggactcaccatgggagttcgggctgagctgggttttccttgttgttattttacaaggtgtccagagtgaagtgcagttggtggagtcccgggggagacttggtccagcctggagggtccctgagactctcctgtgtcgcctctggattcaccatcagtgaccactatatggactgggtccgccaggctccagggaaggggctggagtggcttggccgcagtaaaaaacaaagtgccagctttatcacagagtacgccgcgtctgtgaaaaagccagattcaccctctcaagagatgacttcaagaactcattgattctgcgaatgactaacctgaaaaccgaggacacgggcatgtattattgtgttgtgtttatatcaggaactgtcccactggggccagggaaccctggtcaccgtctcctcagcctccaccaagggcccatcggtcttccccctggcgccctgctccagggagcacctccgagagcacagcggccctgggctgcctggtcaaggactacttcctatatactgtctgagcgggctggcaag

SEQ ID NO: 792182 - DNA, 659 bp, Homo sapiens
  misc_feature: 46222.44.86.H09.1.pb.heavy.1.raw 46222
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttgggctggatccggcagcccccagggaggggaaatggagtggattggtgacatccattatactggggcgacgtactactctccgtccctcaagagtcgtctcaccatttcgagggagcacgtccatgaaccgcttctccctgaaactgacctccgtgaccgccgcggacacggccgtttatttctgtgcgaggcgagactggtctttcaatctatggggccgtggcaccctggtcactgtctccctcagcttccaccaagggcccatcggtcttccccctggcgccctgctccaggagcacctctgggggcacagcggccctgggctgcctggtcaaggactacttcctatatactgtctgagcggggctggcaaggcgcatag

SEQ ID NO: 792183 - DNA, 724 bp, Homo sapiens
  misc_feature: 46235.UNK.UNK.UNK.pb.heavy.1.raw 46235
ctatgcgccttgccagcccgctcagacagtatatagggagtagtccttgaccaggcagcccagggccgctgtgcccccagaggtgctcttggaggagggtgccagggggaagaccgatggcccttggtggaggcggaggcgacggtgaccagggttccctggcccccagaagtcaaaacgaaataataaaccactccgagcgccgacttgttctcgcaccagtaatagacggccgtgtcgtcgcctctcaggttggttcatttgaagataaaaccgtgttcctggaattgtccctggagattggtgaatcggcccttcacggagtctgcgtagtatgtgaaatcaccagtaataaatgactgagaacccactccagccccttccctggagcctggcggacccaactcatgtagttgctgctgacggtgagcccagaggctgcacaggagagtcttctgggaccccccaggctggactaagcctcctccagactccatcagccgcacctcacactggacaccttttaaaagtccaacaaggagaccccagctcagccaaaactccatggtgagtcctcctgtgttcagtgctgattcaccgaatggaaacacctcggaattcccagtgctggggctcctctcccccaaacccaacgtgcgagtgctaaatcgagcaccggttcgtgttaatatactgtctgatggcgcgggagggaggcgatacg

SEQ ID NO: 792184 - DNA, 659 bp, Homo sapiens
  misc_feature: 46249.44.53.E09.1.pb.heavy.1.raw 46249
cgtatcgcctccctcgcgccatcagacagtatatacacgaccggtgctcgatttagagagagtgtgttgagctctggagaggagcccagccttgggattcccaggtgttttcattcagtgatcaggactgaacacagaggactcaccatggagtttgggctgagctggattttccttgctgcctattttaaaaggtgtccagtgtgaggtgcagttggtggagtctgggggaggtttggtaaagcctgggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaacccctggtcaccgtctcctcagcctccaccaagggcccatcggtcttccccctggcgccctgctccaggagcacctccggagagcacagcggccctgggctgcctggtcaaggactacttcctatatactgtc

SEQ ID NO: 792185 - DNA, 691 bp, Homo sapiens
  misc_feature: 46279.44.71.G05.1.pb.heavy.1.raw 46279
cgtatcgcctccctcgcgccatcagacagtatatacacgaccggtgctcgattagtgtcgtcgcaagagagaggagccccagccgtgagattcccaggagtttccacttggtgatcagcactgagcacagaccaccaacatggagtttggctaatcttgattttccttgtagtttttttagaggtgtccagtgcgaggggcgactggcggagtcgggggggggcttggcacagccagggcggtctctgagactctcctgtgtagtctcaggattcagtcttagtgattatcacttggcctgggtccgtcaggctccaggaaggggcttgagtggatcactttcgtcagaatgaaacgttatggtggaagtaaagagtacgccgcgtctgtgaagggaagattcaccgctcaagggatgactccaacagtgttggccatttacaaatgagcaacctgagacccgacgacacaggcgtctattactgcgccaggcgatcctggggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792186 - DNA, 703 bp, Homo sapiens
  misc_feature: 46290.44.55.E11.1.pb.heavy.1.raw 46290
cgtatcgcctccctcgcgccatcagacagtatatacacgaccggtgctcgatttagcactcgcacgttgggtttggggagaggagccccagcactggattccgaggtgtttccattcggtgatcagcactgaacacagaggactcaccatggagttttggctgagctggtttccttgttggacttttaaaaggtgtccagtgtgaggtgcggctgatggagtctgaggaggcttagtccagcctgggggctcccagagactctcctgtgcaggcctctggggcctcaccgtcagccagcaactcatgagtttgggtccgccaggctccagggggaaggggctggagtgggtctcagtcattttatactgtgatttcacatactacgcagactccgtgaaggggccgattcaccatctccagggacaattccagggaacacggtttatcttcaaatgaacaacctgagaggcgacgacacggccgtctattactgtgcgagacaagtcggcgctcggagtggttattattcgtttgacttctggggcagggaaccctggtcaccgtcgcctccgcctccacaagggccatcggtcttcccctggcaaccctctctccaagagcacctctggggcacagcggcctgggctgcctggtcaaggactacttcctatatactgtctgagcggctggcaaggcgcatag

SEQ ID NO: 792187 - DNA, 698 bp, Homo sapiens
  misc_feature: 46309.44.27.C05.1.pb.heavy.1.raw 46309
cgtatcgcctccctcgcgccatcagacagtatatacacgaccggtgctcgattagacgcgatcgaagggtttggggccctgggagacgagcccagcactggaagtcgccggtgtttccactcggtgatcatcactgaacacagaggactcaccatggagtttggctgagctgggttttcctcgttgccctcttaagaggtgtcatgtgtcaggtgcaattcgtggagtctgggggaggcgtggcccagtagggggtccctgagactctcctgtgcagcctctggattcaccttcgataattggaatatgcagtgggtccgccaggctccaggcgaggggctggagtgggtggcaggtgtgtcatttcatggaggaatcaagtctacggtgattccgttgaggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaaggcccatcggtcttccccctggcgcctgctccaggagcacctccgagagcacagcggccctgggctgcctggtcaaggactacttcctatatactgtctgagcgggctggcaaggcgcatag

SEQ ID NO: 792188 - DNA, 645 bp, Homo sapiens
  misc_feature: 46403.UNK.UNK.UNK.pb.heavy.1.raw 46403
cgtatcgcctccctcgcgccatcagacagtatataacgaccggtgctcgatttagtgctatagactgggtttgggatgctttctgagagtcaaggacctcctgtgcagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattgtgacatccattatactggggcgacgtactactctccgtccctcaagagtcgtctcaccatttcgagggacacgtccatgaaccgcttctccctgaaactgacctccgtgaccgccgcgacacggccgtttatttctgtgcgaggcgagactggtctttcaatctatgggccgtggcaccctggtcactgtctcctcagcttccaccaaggggccatcggtcttcccctggcgccctgctccaggagcacctctgggggcacagcggccctgggctgcctggtcaaggactacttcctatatactgtctgagcgggctggcaggcgcatag

SEQ ID NO: 792189 - DNA, 717 bp, Homo sapiens
  misc_feature: 46411.44.36.D03.1.pb.heavy.1.raw 46411
ctatgcgccttgccagcccgctcagacagtatataggaagtagtccttgaccaggcagcccagggccgctgtgctctcggaggtgctcctggagcagggcgccagggggaagaccgatgggcccttggttggaggctgaggaggacggtgaccagggttccctggccccagtggacagttcctgatataaaccacaacacaataaatacatgcccgtgtcctcggtttttcaggttagtcattcgcagaatcaatgagttcttgaagtcatctcttgagagggtgaatctggctttcacagacgcggcgtactctgtgataaaggctggcaactttgtttttactgcggccaaggccactccagccccttccctgggagcctggcgggacccagtccatatagtggtcactgatggtggaatccagaggcgacacaggagagtctcagggaccctccaggctggaccaagtctccccggactccaccaactgcacttcactctggaccaccttgtaaaataacaacaaggaaaacccagctcagcccgaaaatccatggtgagtcctctgtgttcagtgctgatcaccaaatgaaaaacacctgggaattctggggctggggctccgctctcagagctcccaagagagatcgtgacgcagctaaatcgagcaccggtcgtgtatatactgtctgatggcgcgagggaggccgatacg

SEQ ID NO: 792190 - DNA, 648 bp, Homo sapiens
  misc_feature: 46416.44.53.E09.1.pb.heavy.1.raw 46416
ctatgcgccttgcccagcccgctcagacagtatataggaagtagtccttgaccaggcagcccagggccgctgtgctctcggaggtgctcctggagcagggcgcagggggaagaccgatgggcccttggtggaggctgaggatgaggagacggtgacgtggtcccttggcccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttccactataatagagactcccaatccactgcagcccctctcctgggggctggcggatccagccagtgaaaattacttctgtcgatggaggcaccagagacgtgcacgtgagggacagggtctccgaaggcttcaccagtcctgggcccgactccgcagctgcggctgagacaggacccatctggagccgccaccagcaggagggaagaaccacaggtgcttccccccaaacccaacacactctctctaatcgagcaccggtcgtgtatatactgtctgatggcgcgagggaggcgatacg

SEQ ID NO: 792191 - DNA, 694 bp, Homo sapiens
  misc_feature: 46443.44.55.E11.1.pb.heavy.1.raw 46443
ctatgcgccttgccagcccgctcagacagtatataggaagtagtccttgaccaggcagccagggccgctgtgccccagaggtgctcttggaggaggtgccaggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcaggagtctgcgtagtatgtgaaatcaccagtataaatgactgagacccactccagccccttcctggagcctggcggacccaactcatgtagttgctgctgacggtgagcccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctccccccaaacccaacgtgcgagtgctaaatcgagcaccggtcgtgtatatactgtctgatggcgcgaggaggcgatacg

SEQ ID NO: 792192 - DNA, 642 bp, Homo sapiens
  misc_feature: 46447.44.86.H09.1.pb.heavy.1.raw 46447
ctatgcgccttgccagcccgctcagacagtatataggaagtagtccttgaccaggcagcccagggccgctgtggcccccagagggctcctggagcagggcgccagggggaagaccgatgggcccttggtggaagctgaggagacagtgaccagggtgccacggccccatagattgaaagaccagtctcgcctcgcacagaaataaacggccgtgtcgcggcggtcacggaggtcagtttcaggagaagcggttcatggacgtgtcctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatataggcgcgagggaggcgatacg

SEQ ID NO: 792193 - DNA, 694 bp, Homo sapiens
  misc_feature: 46477.44.73.G07.1.pb.heavy.1.raw 46477
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctccggagtctccgtagtgttcttcaattccatcttctgatataattgccaccccactccagccccttgcctggaagcctggcggaccagtgcatggcataggtcctgagatgaatccagaggctgcacaggagagtctcagggagttcccaggctggccgctcctcccccagactccactagctgcacctgacactggccacctcttaaaagagcaacgaggaaaacccatctcagcccaaagtcatggtggagtcccctctgtgttcagtgatgatcaccgaatggaaacaccggcgacttccagtgctgggctcgtctcccccctgagcgtagagctaaatcgagcaccggtcgtgtatatactgtctgatggcgcgaggggaggcgatacg

SEQ ID NO: 792194 - DNA, 630 bp, Homo sapiens
  misc_feature: 46480.UNK.UNK.UNK.pb.heavy.1.raw 46480
ctatgcgccttgccagcccgctcagacagtatataggaagtagtcttgaccaggcagcccagggccgctgtgctctcggagtgctcctggagcagggcgccagggggaagaccgatgggcccttggtggagctgatgagacggtgacctgatccctggccccagggttcgaagaagcccgtgtcatgtggtcatgaagtgggcacagaaatatgtgcctgtgtcccagggtccacgttggtcaatgtaaggaccacctggttttggacgtgtccttcgtgagcgtgagtctggtcgtcagagaaggactatatcgtatatcgtcattccatagtgagtgcgatccactcagccttccgggggctgccgcacccagcaacgccttccaggagtgacgagtgagaagcctgagacggtgcaggtcagcgtgagggtctgatgtgggtttcaccaatgtagggccagactctttcacggtgatctgggacaggccccatgaagggatggtcagctagcaggagcgtggagcaaagtgtgtccatggtggggccacaggagtcccccttactgactcactaaatcgagcaccgttcgtgtatatactgtctgatggcgcgagggaggcgatacg

SEQ ID NO: 792195 - DNA, 705 bp, Homo sapiens
  misc_feature: 46491.44.55.E11.1.pb.heavy.1.raw 46491
ctatgcgccttgccagcccgctcagacagtatataggaagtagtccttgaccaggcagcccagggccgctgtgcccccagaggtgctcttggaggagggtgccagggggaagaccgatgggccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggccccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792196 - DNA, 606 bp, Homo sapiens
  misc_feature: 46534.UNK.UNK.UNK.pb.heavy.1.raw 46534
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgttgagtttacttttattcgtgttggaatgagttgaacttcgggaagtggagtaatgggtttgtctacttcccctaaccgcaaagtactagttttacgagtgggccgttgcaagccatagccagtcacaggtaataaacaattcaacgtgggcgtaaagattggccgcttgctgtggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 792197 - DNA, 728 bp, Homo sapiens
  misc_feature: 46600.UNK.UNK.UNK.pb.heavy.1.raw 46600
cgtatcgcctccctcgcgccatcagacagtatatacacgacggtgctcgatttagagtgagctcgttgggtttgggagctctggggagaggagcccagcaccagaagtcggcggtgtttccagtcggtgatcagcaccgaacacagaggactccaccatggagtttgggctgacctgggttttcctcgttgctcttttaagaggtgtccagtgtcaggtgaagctggtggagtctgggggaggcgtggtccagcctgggaggctccctgagactctcctgtgtagcgtctggattcaccttcaacagacatggcatgcactgggtccgccaggctccaggcaagggactggagtgggtggcacttatatggtatgatggaagtaataaatattatgtagattccgtgaaggccgatttcaccatctccagagacaattcgaagaacacactatatctggaaatgaatagcctgagagccgaggacacggctgtctactactgtgcgagagatggggcctcgtggatacagatatgacatgctctactccaatggtatggacgcctgggcgccaaggaccacggtcgccgtctctcagcctccacccaagggcccatcggtcttcccctggcaccctcctccaagagcacctctggggcacagcgccctggctgcctggtcaaggactacttcctatatactgtctgagcgggctggcaaggcgcatag

SEQ ID NO: 792198 - DNA, 662 bp, Homo sapiens
  misc_feature: 46601.44.86.H09.1.pb.heavy.1.raw 46601
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagccccccagggaggggaatggagtggatttggtgacatccattatactggggcgacgtacttactctccgtccctcaagagtcgtctcaccatttcgagggacaccgtccatgaaccgcttctccctgaaactgaacctccgtgaccgccgcggacacggccgtttatttctgtgcgaggcgagactggtctttcaatctatggggccgtggcaccctggtcactgtctcctcagctttccaccaagggcccatcggtctcccccctggcgccctgctccaggagcacctctgggggcacagcggccctgggctgcctggtcaaggactacttcctatatactgtctgagcggggctgcaaggcgcatag

SEQ ID NO: 792199 - DNA, 686 bp, Homo sapiens
  misc_feature: 46609.UNK.UNK.UNK.pb.heavy.1.raw 46609
cgtatcgcctccctcgcgccatcagacagtatatacacgaccgtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagactccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcaccttcagcttccaccaggcccatcggtctccctggcgccctgctccaggagcacctctgggggcacagcggcctgggcctgcctggtcaaggactacttcctatatactgtctgagcggctggcaaggcgcatag

SEQ ID NO: 792200 - DNA, 640 bp, Homo sapiens
  misc_feature: 46713.44.19.B08.1.pb.heavy.1.raw 46713
cgtatcgcctccctcgcgccatcagacagtatatacacgaccggtgctcgatttagtgagtcagtaaggggactcctgtgccccaccatggacacactttgctccacgctcctgctgctgaccatcccttcatggggcctgtccagatcaccgtgaaagagtctggccctacattggtgaaacccacacagaccctcacgctgactgcaccgtctcaggcttctcactcgtccactcctggagagggcgttgtctgggtgcggcagcccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctgggccagggaatccaggtcaccgtctcatcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 792201 - DNA, 720 bp, Homo sapiens
  misc_feature: 46778.UNK.UNK.UNK.pb.heavy.1.raw 46778
ctatgcgccttgccagccgctccagacagtatataggaagtagtccttgaccaggcagcccagggccgctgtggctctcggaggtgctcctggagcagggcgccagggaagaccggatgggcccttggtggagggccgaggagacggtgaccacagggttccctggcccaggcgtcgaatgaaaccgattttggaaaacagatagtctcgcacaaaaatacacggccgtgtcctgaggtctcaaggctgttcatttgaagagacacagctgtgttctccggaattgtcctctggagatggtgaatcggccctcaaacggaatcacgcgtagacttgatttcctccatgaaatgacacacctggccaccactccagccccctcgcctggagcctggcggacccactgcatattccaattatcgaaggtgaatccagaggctgcacaggagagtctcagggacccccctactggggccacgcctccccagactccacgattgcacctgacacatgacacctcttaagagggcaacgaggaaaacccagctcagcccaaactccatggtggagtcctctgtgttcagtgatgatcaccgagtggaaacaccgggcgacttccagtgctgggctcgtctcccaggccccaaacccttcgatcgcgtctaaatcgagcacccggtcgtggtatatactgtctgatggcgcgagggaggcgatacg

SEQ ID NO: 792202 - DNA, 1236 bp, Homo sapiens
  misc_feature: 46798.44.78.H01.1.pb.heavy.1.raw 46798
cgtatcgcctccctcgcgccatcagacagtatatacacgaccgggtgctcgatttagagaggtggttgggtttggggggaagcacctgtggttctcctccctgtggtggcggctcccagatggcgtcctgtctccagccgcagctgcgggcagtcgggccaggactggtgaaagccttcgagaccctgtccctccacggtgcccacggtctctggtgccctccatcgacagaaccttaatttctactgggggctggatccgccagcccccccaggagaggggctgcagggtggattgggagtctctattatagtgggaacacctactacaaccgtcctcaacgggtcgagtcgcaccatatccctggacacgtcgaaggacacagttttccctgaaagtgaggtctgtgccgccgcccgacacggctgtctacctactgtgtcagacatgtgtccgcctatggcaggtcgtctcaattctactacgcttggacgtctgggccaagggaccacggtcaccgtctcctcatcctcagcctccaccaagggcccatcggtcttcccccctggcgccctgctccaggagcacctccgagagcaagcggccctggctgcctggtcaaggactacttcctatatactgtctgagcgggctggcaaggcgcatagctatggcgccttgcagcccgctcagacagtatataggaagtagtccttgaccaggcagccaggccgctgtgctctcgaggtgctcctggagcagggcgccaggggaagaccgatgggccccttggtgggaggctgaggagacggtgaccagggttcccggccacaagtcaagcaggtgctgtggctccgcacagaaatacacggccgcgtgtcctcagatctcaggctgctcagtttccatgtagactgtacctgggggaggtgctcctggtcatactaactctgccttggaactctgggcaaagcccgtgttgccactatagggcttcatccatccatccactccagcccttgtccagcggcctgtcgcacccagttaatatcataatgatgaacgtgtatccagaaagcgtgcagggagactgtcacctgaggccccaggcttcttcacctcagcaagcgtggtgacgtgacctccagcaacttcggcacccaaacccaaactactcacactaaatcgagcaccggtcgtgtatatactgtctgatggcgcgagggaggcgatacg

SEQ ID NO: 792203 - DNA, 673 bp, Homo sapiens
  misc_feature: 46801.44.71.G05.1.pb.heavy.1.raw 46801
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggtgaccggggtccctttgccccagacgtccatgtagtagtaatacttgtattgttgtaacttctgcgaccctctggcacagtaataaagggccgtgtcgtccactcgcaggcctcttcatctgcagaaacaccgtattcttggaattgtccctggagacgatgaagcggcccttcacggagtctgcgacatttgtggcactaccaccagtaatggatgagacccactccagccccttccctggggcctgacggacccagatcatggcataggtattaaaggcgaatccagaggctgcacaggagagtgtcagggaccccccggctgtaccaagcctccccccgactccaacagctgcacttcacactggacaccttttaaaacagccacaagaaaaagccagctcagcccaaactccatggtgagttctctctgttcagtcccagggctgggcccctctctcttgcgacgacactaaatcgagcaccggtcgtgtatatactgtctgatggcgcgagggaggcgatacg

SEQ ID NO: 792204 - DNA, 679 bp, Homo sapiens
  misc_feature: 46802.44.35.D02.1.pb.heavy.1.raw 46802
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcggggcccaggacgggtgaagccttcggagaccctgtccctcacctgcaatgtctctggtggttacatcagtagttattattggagttggctgcggcagtccgccggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792205 - DNA, 690 bp, Homo sapiens
  misc_feature: 46806.44.74.G08.1.pb.heavy.1.raw 46806
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccgggcagaattacgattaccgcgacaagtccacagacacagtctccatgacaatgagttctttgaaatccgacgacacggccgtctactactgtgcgagaggtccgtacccagctcgcatggagcctttgagatctgggggcagggaaccctggtcattgtcacctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 792206 - DNA, 701 bp, Homo sapiens
  misc_feature: 46839.44.74.G08.1.pb.heavy.1.raw 46839
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgccccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtagggtgagtgagcccaaaaagagggatgattccacccatccactcaagcccttgtccaggggcctggcgcacccagttgatggtataagtagtggaactggtagtacttccagaggccgtgcaggaaagggtcaccgaggaccaaggttgcggcatttctagtcccagactgcaccagttgcaccagggactggaccacctgttgctgctgccaccacaaagaggaacctccaggtccagtccatggtgatgagctgttgctcccagggggcttctttagaggaggaatgtggttgttatgtgatgctccccctgatagagctactaaatcgagcaccggtcgtgtatatactgtctgatggcgcgaggagggcgatacg

SEQ ID NO: 792207 - DNA, 611 bp, Homo sapiens
  misc_feature: 46867.UNK.UNK.UNK.pb.heavy.1.raw 46867
cccgacacgcttgctagggacttggagctaaggacgacatattgcctttagacagtcgaaggtgacgccttagctaccactgaacgtttaggcgccagatgccggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgtgcaagccatagccagtcacaggtaataacaattcaacgtggcgtaaagattggccgcttgctgtgggcattgcaagctgggtttgcagcattgtgcatgctagacgacaatatgaaatctgcgggaccccctagtgggccaagatggccgctagcgggttccgcagcttttgacctggaccaggggtgcatagcctgcccagccttc

SEQ ID NO: 792208 - DNA, 655 bp, Homo sapiens
  misc_feature: 46868.44.86.H09.1.pb.heavy.1.raw 46868
ctatgcgccttgccagcccgctcagacagtatataggaagtagtccttgaccaggcagcccagggccgctgtgcccccagaggtgctcctgagcagggcgccagggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtccctcgaaatggtggagacgactcttgagggacggagagtagtacgtcgcccccagtataatggatgtcaccatccactccattcccctccctggggctgccggatccagccccaagaatgatcagaactgatggaaactccagagacagtgcagatgagagacaggggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgatagtatagactggatggcgcgagggaggcgatacg

SEQ ID NO: 792209 - DNA, 648 bp, Homo sapiens
  misc_feature: 46904.44.23.C01.1.pb.heavy.1.raw 46904
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcagagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtgcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792210 - DNA, 701 bp, Homo sapiens
  misc_feature: 46906.44.27.C05.1.pb.heavy.1.raw 46906
cgtatcgcctcctcggcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtgggagtctgggggaggcgtggcccagtagggggtccctgagactctcctgtgcagcctcggatttcaccttcgataattggaatatgcagtgggtccgccaggctccaggcgagggctggagtggtggcaggtgtgtcttttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctcaccaagggccatcggtcttccccctggcgccctgctccaggagcacctccgagagcacagcggcctgggctgcctggtcaaggactacttcctaatatactgtctgagcgggctggcaaggcgcaatag

SEQ ID NO: 792211 - DNA, 639 bp, Homo sapiens
  misc_feature: 46912.44.23.C01.1.pb.heavy.1.raw 46912
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaaggactacttcctatatactgtctgagcgggctg

SEQ ID NO: 792212 - DNA, 603 bp, Homo sapiens
  misc_feature: 46931.UNK.UNK.UNK.pb.heavy.1.raw 46931
gaaggctgggcaggctatgcaccctggtccaggtcaaaagctgcggaacccgctagcggccatcttggccactaggggttccgcagattcatattgtcgtctagcatgcacaatgctgcaaaccagcttgcaatgccacagcagcgccaatctttacgccacgtttgaattgtttattacctgtgactggctatggctgcaacgccactcgtaaaactagtacttgcggttaggggaagtagacaaacccattactccacttccggaagttcaactcaattccaacacgaaataaaagtaaactcaacaccccaagcaggctatgtggagggtgaataggggtggattctatttcctatcccattcccctaggatctcaattaagttacagcgagttaaatgtctgtagcgatcccgtcagtcctatcgcgcgcatcaagacctggttggtttgagcgtgcagtagatcatcgataagctgcgagttaggtcatcccagaccgcatctggcgcctaaacgttcagtgtagctaaggcgttcaccttcgactgtctaaaggcatatgtcgtccttagctccaagtccctagcaagcgtgtcggg

SEQ ID NO: 792213 - DNA, 585 bp, Homo sapiens
  misc_feature: 46932.44.78.H01.1.pb.heavy.1.raw 46932
ctatgcgccttgccagcccgctcagacagtatataggaagtagtccttgaccaggcagccagggccgctgtgctctcggaggtgctcctggagcagggcgccaggggaagaccgatggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagccgtgttgccactatagggcttcatccatcccatccactccagcccttgtccagcgcctgtcgcacccagttaatatcataattgatgaacgtgtatccagaagccgtgcaggagactgtcactgaggccccaggcttcttcacctcagcccagactgcaccagctgtacctgggagtgggaccgtcagtcttcctcttcccccaaacccaaactactcacactaaatcgagcaccggtcgtgtatatactgtctgatggcgcgagggaggcgatacg

SEQ ID NO: 792214 - DNA, 697 bp, Homo sapiens
  misc_feature: 47004.UNK.UNK.UNK.pb.heavy.1.raw 47004
cgtatcgcctccctcgcgccatcagacagtatatacacgacccgtgctcgatttagcactcgcacgttgggtttggggggagaggagccagcactgggattccgaggtgtttccattcggtgatcagcactgaacacagaggactcaccatggagttttggctgagctgggttctccttgttggacttttaaaagtgtccagtgtgaggtgcggctgatgagtctggggaggcttagtccagcctgggggtccagagactctcctgtgcagccctctgggctcaccgtcagcagcaactacatgagttgggtccgccaggctccagggaaggggctggagtgggtctcagtcatttatactggtgatttcacatactacgcagactccgtgaagggccgattcaccatctccagggacaattcaggaaacacggtttatcttcaaatgaacaacctgagaggcgacgacacggccgtctattactgtggcgagacaagtcggcgctcggagtggttattattcgttgacttctgggccaggaaccctggtcaccgtcgcctccgcctccaccaagggcccatccggtcttcccctggcaccctcctccaagagcacctctgggggcacagcggccctggctgcctggtcaaggactacttcctatatactgtctgagcgggctggcaaggcgcatag

SEQ ID NO: 792215 - DNA, 665 bp, Homo sapiens
  misc_feature: 47040.44.74.G08.1.pb.heavy.1.raw 47040
tatgcgccttgccagcccgctcagacagtatatagggaagtagtcctgaccaggcagccaggccgctgtgcccagagtgctcctggagcagggcgccaggggggaagacgatgggcccttggtgaagctgaggtgacaatgaccaggggtcccctgcccccccagatctcaaaggctccatgcgagctgggggtacggactctcgcacagtagtagacggccgtgtcgtcggatttcaaagaactcatgtcatggagactggtgttgtggacttgtccgcggtaatcgtattctgcccccggaagtctcgtgcgtaggtgagtgagccaaaagagggatgatcccccatccactcaagcccttgcccggggctggcgcaccagttgatggtaagtagtggaactggtagtacttcgaggccgtgcagaaaggggtcaccgaggaccaagttgcggcatcttcccagactgcaccagttgcaccggggactggacactgttgctgctgccaccacagaggacctccagtccgtcatggggatgagctgtgctccagggcttctttagaggaggaatgtggtgttatgtgatgcccccctggatagagctactaaatcgagcaccggtcgtgtatatactgtctgatggcgcgagggaggcgatacg

SEQ ID NO: 792216 - DNA, 673 bp, Homo sapiens
  misc_feature: 47053.44.6.A06.1.pb.heavy.1.raw 47053
cgtatcgcctccctcgcgccatcagacagtatatacacgaccggtgctcgatttagatctactgacaaccacattcctcctctaaagaagcccctgggagcacgctcatcaccatggactggacctggaggttcctctttgtggtggcagcagcaacaggtgtccagtccctggtgcaaactggtgcagtctgggactagaatgccgcaaccttggtcctcggtgaccctttcctgcacggcctctggaagtactaccagttccactacttataccatcaactgggtgcgccaggccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792217 - DNA, 704 bp, Homo sapiens
  misc_feature: 47082.44.36.D03.1.pb.heavy.1.raw 47082
ctatgcgccttgccagcccgctcagacagtatataggaagtagtccttgaccaggcagcccagggccgctgtgctctcggagggtgctcctggagcagggcgccagggggaagaccgatgggcccttggtggaggctgaggagacggtgaccagggttcctggccccagtggacagttcctgatataaacacaacaacaataatacatgcccgtgtcctcggttttcaggttagtcattcgcagaatcaatgagttcttgaagtcatctcttgagagggtgaatctgctttcacagacgcggcgtactctgtgataaagctggcaactttgttttttactgcggccaagccactccagccccttccctgggagcctggcggacccagtccatatagtggtcactgatggtgaatccagagcgacacaggagagtctcaggaccctccaggctgaaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctccgctctcagagctccccaagagagatcgtgacgcagctaaatcgagcaccggtcgtgtatatactgtctgatggccgcgagggaggcgatacg

SEQ ID NO: 792218 - DNA, 687 bp, Homo sapiens
  misc_feature: 47116.44.55.E11.1.pb.heavy.1.raw 47116
cgtatcgcctccctcgcgccatcagacagtattacacgaccggtgctcgattagcactcgcacgttgggttggggggagaggagcccagcactggattccgaggtgtttccattcggtgatcagcactgacacagaggactcaccatggagttttggctgagctgggttctccttgttggactttaaaggtgtccagtgtgaggtgcggctgatggagtctggaggaggcttagtccagcctggggggtcccagagactctcctgtgcagcctctgggctcaccgtcgcagcaactacatgagttgggtccgccaggctccaggaaggggctggagtggtctcagtcatttatactggtgatttcactactacgcagactccgtgaagggccgattcaccatctccagggacattccaggacacggttatcttcaatgaacaacctgagaggcgacgaccggccgtctattactgtgcgagacaagtcggcgctcggagtggttattattcgtttgacttctggggccagggaaccctggtcaccgtcgcctccgcctccaccaagggcccatcggtcttcccctggcaccctcctcaagagcacctctgggggcacagcggccctgggctgcctggtcaaggactacttcctatatactgtctgagcgggctggcaaggcgcatag

SEQ ID NO: 792219 - DNA, 700 bp, Homo sapiens
  misc_feature: 47139.UNK.UNK.UNK.pb.heavy.1.raw 47139
cgtatcgccccctcccgcgccatcagacagtatataccacgcgaccgtgctcgatttagctgcgtcacgatctctctggggagctctgagagcgagcccagccccagaattccagtgttttcatttggtgatcagcactgaacacagaggactcaccatggagtctcgggctgagctgggtttttctgttgttattttacaggtgtccagagtgaagtgcagttggtggagtccgggaagactggtccagcctggagggtccttgagactctcctgtgtcgcctctggattcaccatcagtgaccactatatggacttcgggtccgcaggctccagggaagggggctggagtggcttggccgcagtaaaaaccaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaacccggtcaccgtctcctcagcctccacaaggcccatcggtcttccccctggcgccctgctccaggagcacctccgagagcacagcggccctgggctgcctggtcaaggactacttcctatatactgtctgagcgggctggcaaggcgcatag

SEQ ID NO: 792220 - DNA, 615 bp, Homo sapiens
  misc_feature: 47144.44.23.C01.1.pb.heavy.1.raw 47144
ctatgcgcctgccagccgctcagacagtatataggaagtagtccttgaccaggcagcccaggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaccacaggtgttcaccctgccccaatccctaatcacgtgtactaaatcgagcaccggtcgtgtatatactgtctgatggcgcgagggaggcgatacg

SEQ ID NO: 792221 - DNA, 699 bp, Homo sapiens
  misc_feature: 47188.44.45.E01.1.pb.heavy.1.raw 47188
cgtatcgcctccctcgcgccatcagacagtatatacacgaccggtgctcgatttagtgagtcagtaagggaaaggggctgggagaggagcccagcactagaagtcggcgtgttttccattcggtgatcagcactgaacacagaggactcaccatggagtttgggctgagctggggttttcctcgttgctctttttaagaggtgtccagctgtcaggttcagctggtgggagtctgggggaggcgtggtccagcctggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaaaaacaccgtgtatctacaaatgaacaatttgagagccgaggactcgcgctctctattattgtacgagccatcgttctactgggggccagggagccctggtcaccgtctcctccagcctccacccaagggcccatcggtcttccctggcgccctgctccaggagcacctccgcaggagcacagcggcccctgggctgcctggtcaaggactactttcctatatactgtcctgagcggtgctggcaaagccgcaagggatag

SEQ ID NO: 792222 - DNA, 701 bp, Homo sapiens
  misc_feature: 47199.44.36.D03.1.pb.heavy.1.raw 47199
ctatgcgccttgccagcccgctcagacagtattaggaagtagtccttgaccaggcagcccagggccgctgtgctctcggaggtgctcctggagcagggcgccagggggaagaccggatgggcccttggtggaggctgaggagacggtgaccagggttccctggccccagtggacagttcctgatataaacacaacacaataatacatgcccgtgtcctcggttttcaggttagtcattcgcagaatcaatgagttctttgaagtcatctcttgagagggtgatctggctttcacagacgcggcgtactctgtgataaagctggcaactttgtttttactgcggccaagccactccagcccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcaggcccgaactccatggtgagtcctctgtgttcagtgctgattcaccaaatgaaaaacacctgggaattctggggctggggctccgctctcccccaagagagatcgtgacgcagctaaatcgagcaccggtcgtgtatatactgtctgatggcgcgagggaggcgatacg

SEQ ID NO: 792223 - DNA, 571 bp, Homo sapiens
  misc_feature: 47407.44.37.D04.1.pb.heavy.1.raw 47407
ctatgcgccttgccagcccgctcagacagtatataggaagtagtccttgaccaggcagcccagggccgctgtgcccccagaggtgctcctggagcagggcgcagggggaagaccgatggcccttggtggaagctgaggagacggtgaccgacgtccccctgccccagacatccatcaaatagtagtagttttatgattccccgaaccgtttccttggaggtccccctcgcacaagtaataaacagacgtgtcgtcaactctcaccgctgttcatttggcaaatacagcatattcttggaattgtctctgagatggtgaatcggcccttcacggagtctgagtaatacttctcacttccatcgtcggagatgactgccacccactccggccccttgcctggagcctggcggacccagtgcaaaccaaatctatcgaatgagaacccagaggctacacaggagagtctcagggacctccgggctggaccacgcctcccccaacccaacagtatgctactaaatcgagcaccggtcgtgtatatactgtctgatggcgcgagggaggcgatacg

SEQ ID NO: 792224 - DNA, 690 bp, Homo sapiens
  misc_feature: 47420.UNK.UNK.UNK.pb.heavy.1.raw 47420
cgtatcgcctccctcgcgccatcagtctatactatcacgaccggtgctcgattttgatcacataacaaccacactcctcctctaaagaagcccctgggagcacagctcatcaccatggactggacctggcggttcctctttgtggtggcagcagctacaggtgtccagtcccaggtgcagctggtgcagtctgggctgaggtgaagaagcctgggtcctcggtgaaggtctcctgcaaggcttctggaggcaccttcttcagctatgcttttatttgggtgcgacaggcccctggacaagggcttgagtggctgggagggatcatccctatctttggtgcatcgaattacgcacagaagtttcaggacagagtcaccattaccgcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttccccctggcgcctgctccaggagcacctctggggcacagcggccctgggctgcctggtcaaggactacttcctatatactgtctgagcgggctggcaaggcgcatag

SEQ ID NO: 792225 - DNA, 648 bp, Homo sapiens
  misc_feature: 47438.44.86.H09.1.pb.heavy.1.raw 47438
cgtatcgcctcctcgcgccatcagacagtatatacacgaccggtgctcgattttagtgctatagacttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccgacagcccccagggaggggaatggagtggattggtgacatccattatactggggcgacgtactactctccgtcctcaagagtcgtctcaccatttcgaggggacacgtccatgaaccgcttctcctgaactgacctccgtgaccgcgcggacacggccgttattctgtgcgaggcgagactggtctttcaatctatggggccgtggcaccctggtcactgtctcctcagcttccaccaagggcccatcgtcttccccctggcgccctgctccaggagcacctctgggggcacagcggccctgggctggcctggtcaaggactacttcctatatactgtctgagcgggctggcaaggcgcatag

SEQ ID NO: 792226 - DNA, 699 bp, Homo sapiens
  misc_feature: 47441.UNK.UNK.UNK.pb.heavy.1.raw 47441
cgtatcgcctccctcgcgccatcagacagtatatacacgaccggtgctcgatttagttgctatagacttgggttggggagctcgggagaggagcccagcacagaagtcggcgtgtttccagtcgatgatcagcaccgaacacagaggactcaccatggagttgctgacctgggttttcctcgttgctcttttaagaggtgtcagtgtcaggtgaagctggtggagtctggggaggcgtgtccagcctgggaggtccctgagactctcctgtgtagcgtctggatcaccttcaacagacatggcatgcactggtcgccaggctccaggcaagggactgagtggtggcacttatatggtatgatggaagtaataaatattatgtagattccgtgaaggccgattcaccatctccagagacaattcgaggaacacactatatctggaaatgaatagcctgagagccgaggacacggcgtctactactgtgcgagagatggggctcgggatacagatatgacatgctctactccaatggtatggacgcctggccaggacacggtcgccgtctcctcagcctccaccaaggcccatcggtcttcccctggcacctcctcaagagcacctctgggcacagcggccctgggctgcctgtcaaggactacttctatatactgtctgagcgggctgcaaggcgcatag

SEQ ID NO: 792227 - DNA, 1299 bp, Homo sapiens
  misc_feature: 47443.44.23.C01.1.pb.heavy.1.raw 47443
ctatgcgccttgccagcccgctcagacagtatataggaagtagtccttgaccaggcagcccagggccgctgtgccccagaggtgctcttggaggagggtgccaggggaagacgatggccctggtggaggcggaggcgacggtgaccaggttcctggccccagaagtcaaacgaataataccactccgagcgccgacttgtctcgcacagtaatagacggccgtgtcgtcgcctctcaggttgttcatttgagataaaccgtgttcctggatatgtccctggagatggtgaatcggcccttcacggagtctgcgtagtatgtgaaatcaccagtataaaatgactgagacccactccagcccttccctggagcctggcggacccaactcatgtagttgctgctgacggtgagcccagaggctgcacaggagagttctgggacccccaggctggactaagcctcctccagactccatcagccgcacctcacactggacacctttaaaagtccaacaaggagaaacccagctcagcaaaactccatggtgagtcctctgtgttcagtgctgatcaccgaatggaaacacctcggaatcccagtgctgggctcctctcccccccaaaccaatatgtattactctaaatcgagcaccggtcgtgtatatactgtctgatggcgcgagggaggcgatacgctatgcgccttgccagccgctcagacagtatataggaagtagtccttgaccaggcagccagggccgctgtgcccccagagtgctcctggagcagggcgccagggggaagaccgatggcccttggtggaagctgaggagacagtgaccagggtgccacggccccatagattgaaagaccagtctcgcctcgcacagaataaacggccgtgtccgcggcggtcacgaggtcagtttcagggagaagcggttcatgacgtgtccctcgaaatgtgagacgactcttgagggacggagagtagtacgtcgccccagtataatggatgtcaccaatccactccattcccctccctgggggctgccggatccagcccagaatgatcagaactgatggaaactccagagacagtgcagatgagagacagggttcccgaaggcctcaccagtcctggccgactcctgcagctgcacctggacaggacccatctgggagctgccacagcagaggaaaaaccacaggtttcaccctgccccaatccctaatcacgtgtactaaatcgagcaccggtcgtgtatatactgtctgatggcgcgaggaggcgataccg

SEQ ID NO: 792228 - DNA, 650 bp, Homo sapiens
  misc_feature: 47450.44.12.B01.1.pb.heavy.1.raw 47450
ctatgcgccttgccagcccgctcagacagtatataggaagtagtccttgaccaggcagccaggccgctgtgccccagaggtgctctggaggagggtgccaggggaagaccgatgggcccttggtggagctgaggagaccggtgaccagggttccctggcccagtggtcaaagtagttggtgacgaactgccctactctcgcacagtaatacacggccgtgtcgcggcggtcacagagctcagcttcagggagaactggttcttggacgtgtctactgatatggtgactcgactctgagggacgggttgtagtaggtgctccactataatagatactcccaatccactccagcccttccctggggctggcggatccagccccagtagtaactactactgctgatggagccaccagagacagtgcaggtgagggacagggtctccgaaggcttcaccagtcctgggcccgactcctgcagctgcagctggacaggacccatctgggagccgccacagcaggaggaagaaccacaggtgcttcatgtcttgcacaggaggtccatgactctcagaaagcccccgcgggatctacactactaaatcgagcaccggtcgtgtatatactgtctgatggcgcgaggaggcgatacg

SEQ ID NO: 792229 - DNA, 687 bp, Homo sapiens
  misc_feature: 47453.44.74.G08.1.pb.heavy.1.raw 47453
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccacccatccactcaagccttgtccaggggcctggcgcacccagttgatggtataagtagtggaactggtagtacttccagaggcgtgcaggaagggtcaccgaggaccaaggttgcggcattctgtccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 792230 - DNA, 643 bp, Homo sapiens
  misc_feature: 47455.UNK.UNK.UNK.pb.heavy.1.raw 47455
atgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaataaacggccgtgtccgcggcggtcacggaggtcagtttcagggagaagcggttcatggacgtgtccctcgaatggtgagacgactcttgagggacggagagtagtacgtccgcccccagtataatggatgtcaccaaatccactccattcccctccctggggctgccggatccagccccagaatgatcaacgatggaaactccagagacagtggcagatgagagacagggttcccgaggcctcaccgtcctggcccgactcctgcagctgcacctgggacaggacccatctgggagcgcaccagccaggaggaaaaaccacaggtgcttcatgttcttgcacaggaggtccttgactctcagaaagcatccccaaacccagtctatagcactaaatcgagcaccgtcgtgtatatactgtctgatggcgcgagggaggcgatacg

SEQ ID NO: 792231 - DNA, 689 bp, Homo sapiens
  misc_feature: 47458.44.67.G01.1.pb.heavy.1.raw 47458
ctatgcgccttgccagccgctcagacagtatataggaagtagtccttgaccaggcagcccaggccgctgtgccccagaggtgctcttggaggagggtgccaggggaagaccgatgggcccttggtggaggcggaggcgacggtgaccagggttccctggccccagaagtcaacgaataataacactccgagcgccgacttgtctcgcacagtaatagacggccgtgtcgtcgcctctcaggttgttcatttgaagataaaccgtgttcctggaattgtccctggagatggtgaatcggcccttcacgagtctgcgtagtatgtgaaatcaccagtataaatgactgagacccactcagccccttccctggagcctggcggacccaactcatgtagttgctgctgacggtgagcccagaggctgcacaggagagtctctgggacccccaggctggactaagcctcctccagactccatcagccgcacctcacactggacacctttaaaagtccaacaaggagaacccagctcagccaaactccatggtgagtcctctgtgttcagtgctgatcaccgaatggaaacacctcggatccagtgctggctctctccccccaaacccaatatgtatactctaatcgagcaccggtcgtgtatatactgtctgatggcgcgagggaggcgatacg

SEQ ID NO: 792232 - DNA, 706 bp, Homo sapiens
  misc_feature: 47462.44.36.D03.1.pb.heavy.1.raw 47462
ctatgcgccttgccagcccgctcagacagtatataggaagtagtccttgaccaggcagcccagggccgctgtgctctcggaggtgctcctggagcagggcgccagggggaagaccgatggccccttgtggaggctgaggagacgggtgaccagggttcctggccccagtggacagtttcctgatataaacacaacacaataatacatgccgcgtgtcctcggttttcaggttagtcattcgcagaatcaatgagttcttgaagtcatctcttgagagggtgaatctggctttcacagacgcggcgtactctgtgataaagctggcacctttgttttttactgcggccaagccactccagccccttccctggagcctggcggccccagtccatatagtggtcactgatggtgaatccagaaggcgacacaggagagtctcagggaccctccaggctggaccaagtctccccggactccaccaactgcacttcactctggacaccttgtaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgttatatactgtctgatgcgcgagggaggcgatacg

SEQ ID NO: 792233 - DNA, 721 bp, Homo sapiens
  misc_feature: 47467.44.85.H08.1.pb.heavy.1.raw 47467
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctccttttaagaggtgtccagtgtcaggtgcagctggtggagtctggggaggcgtggtccagcctgggaggtccctgagactctcctgtgcagcgtctggattcaccttcagtacctatggcatgcactgggtcgccaggctccaggcaggggctggagtgggtggcacttatatggtatgatggaagtaataaatactatgcagactccgtgaagggccgattcaccatctccagagacaattccaagaacacgctgtatctgcaaaatgaacagcctgagagcccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctggggcacagcggcctgggctgcctggtcaaggactacttcctatatactgtctgagcgggctggcaaggcgcatag

SEQ ID NO: 792234 - DNA, 707 bp, Homo sapiens
  misc_feature: 47471.UNK.UNK.UNK.pb.heavy.1.raw 47471
cgtatcgcctccctcgcgccatcagacagtatatacacgaccgtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggggcacagcggccctgggctgcctggtcaaggactacttcctatatactgtctgagcgggctggcaaggcgcaatag

SEQ ID NO: 792235 - DNA, 709 bp, Homo sapiens
  misc_feature: 47519.44.36.D03.1.pb.heavy.1.raw 47519
cgtatcgcctccctcgcgccatcagacagtatatacacgaccggtgctcgatttagctgcgtcacgactctcttttggggagctctgagagcgagccccagccccagaattcccaggtgtttttcatttggtgatcagcactggaacacagaggactcaccatggagttcggggctgagctgggttttccttgttgtttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaaagggcccatcggtcttccccctggcgccctgctccaggagcacctccgagagcacagcggccctggctgcctggtcaaggactacttcctatatactgtctgagcgggctggcaaggcgcatag

SEQ ID NO: 792236 - DNA, 616 bp, Homo sapiens
  misc_feature: 47536.UNK.UNK.UNK.pb.heavy.1.raw 47536
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtacttttgcggttaggggaagtagacaaaacccattactccacttcccggaagttcaactcattccaacacgaaataaaagtaaaactcaacaccccaagcaggctatgtgggggggtgataggggtggattctatttcctatcccatcccctaggatctcaattaagttactagcgagttaaatgtctgtagcgatcccggtcagtcctatcgcgcgcatcaagacctggttggttgagcgtgcagtagatcatcgataagctgcgagttaggtcatcccagaccgcatctggcgcctaaacgtttcagtggtaagctaaggcgtcaccttcgactgtctaaaggcaatatgtcgtccttagcttccaagtccctagcaagcgtggtcggg

SEQ ID NO: 792237 - DNA, 686 bp, Homo sapiens
  misc_feature: 47541.44.55.E11.1.pb.heavy.1.raw 47541
cgtatcgcctccctcgcgccatcagacagtatatacacgaccggtgctcgatttagcactcgcacgttgggtttgggggggagaggagcccagcactgggattccgaggtgtttccattcggtgatcagccactgaacacagaggactcaccatggagttttggctgagctgggttctccttgttggacttttaaaaaggtgtccagtgtgaggtgcggctgatggagtctggaggaggcttagtccagcctggggggtcccagagactctcctgtgcagcctctgggctcaccgtcagcagcaactacatgagttgggtccgcggccaggctccagggaagggggctggagtgggtctcagtcatttatactggtgatttcacatactacgcagactccgtgaagggccgattcaaccatctccagggacaaattccaggaacacggtttatcttcaaatgaaacaacctgagaggcgacgacacggcccgtctattaccgtgcgagacaagtcggcgctcggagtggttattattcgtttgacttctggggccaggaaacccctggtcaccgtcgcctccactccaccaagggcccatcggtctttccccctggcaccctcctccaagagcacctctgggggcacagcggccctgggctgcctggtcaaggactacttcctata

SEQ ID NO: 792238 - DNA, 597 bp, Homo sapiens
  misc_feature: 47561.UNK.UNK.UNK.pb.heavy.1.raw 47561
gaaggctgggcaggctatgcacctggtccaggtcaaaagctgcggaacccgctagcggccatcttggccactagggtccgcagattcatattgtcgtctagcatgcacaatgctgcaaaccagcttgcaatgcccacagcaagcggccaatctttacgccacgttgaattgtttattacctgtgactggctatggcttgcaacgccactcgtaaaactagtacttgcggttagggaagtagacaaaccattactccacttcccggaagttcaactcattccacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtccctagcagcgtgtcgg

SEQ ID NO: 792239 - DNA, 721 bp, Homo sapiens
  misc_feature: 47707.UNK.UNK.UNK.pb.heavy.1.raw 47707
ctatgcgccttgccagcccgctcagacagtatataggaagtagtccttgaccaggcaggcccaggggccgctgtgctctcggaggtgctccctggagcagggcgccaggggaagaccggatgggcccttggtggaggctgaagagacggtcaccactgtcccccggccccaagtactaaagtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagaccccactccagtcccctccctgggagcccggcggacccaggtcatgccataggcactaaaggtgaatccaagaggccgcacaggagagggtcagggagcctcccaggccgaatcaggccccccccagactccaacaactgcacttcacacacgacaccctttaaaaaagccacaagaaaaaggcagctcagcccaaactccatggagacttctctctgttcggtcctgggtcaccaaatgaagacacctgaaaatcccagggctgggctcctctctcagagctcccctttccctttatgcgaactactaaatcgagcaccggtcgtgtatatactgtctgatgggcgcgagggaggcgatacg

SEQ ID NO: 792240 - DNA, 696 bp, Homo sapiens
  misc_feature: 47769.44.62.F07.1.pb.heavy.1.raw 47769
cgtatcgcctccctcgcgccatcagacagtatatacacgaccggtgctcgatttagtagtcgcataaagggaaagggagctctgagagaggagcccagccctgggatttcaggtgtcttcatttggtgaccagacgaacagagagaagtctccatggagtttgggctgagctgcctttttcttgtggctttttaaagggtgtcgtgtgtgaagtgcagttgttggagtctggggggcctgattcgcctgggaggtccctgaccctctcctgtgcggcctctggattcacctttagtgcctatggcatgacctgggtccgccggctccaggaggggactggagtgggtctcaagtatcggagctggtggtgtcactttctacggagactccgtgaagggccgcttcaccatttccagggacaattcgcaggacaaattgtttctcaaatgaaaaacctgagacccgaggacacaggcgtctattactgtttgaaagccaggacacggtgaccccccatgacacctttagtacttggggccgggggacagtggtgaccgtccttcagcctccaccaagggccatcggtcttcccctggcgccctgctccaggagcacctccgagagcacagcggccctggctgcctggtcaaggactacttcctatatactgtctgagcgggctggcaaggcgcatag

SEQ ID NO: 792241 - DNA, 733 bp, Homo sapiens
  misc_feature: 47770.44.33.C11.1.pb.heavy.1.raw 47770
ctatgcgcccttgccagcccgctcagacagtatataggaaagtagtccttgaccaggcagcccagggccgctgtgcccccaaaggtgctcttggagggagggtgccagggggaagaccgatgggcccttggtggaggctgaggagacggcgaccgtggttccttggccccaggcgtccataccattggagtagagcatgtcatatctgtatccacgagccccatctctcgcacagtagtagacagccgtgtcctcggctctcagctattcatttccagatatagtgtgttcttcgaattgttctctggagatggtgaatcgggcccttcacggaatctacataatatttattacttccatcataccatataagtgccacccactccagtcccttgccctggagcctggcggacccagttgcatgccatgtctgttgaaggtgaatccagacgctacacaggagagtctcagggacctcccaggctggaccacgcctccccagactccaccagctcacctgacactggacacctcttaaaagagcaacgaggaaaacccaggtcagcccaaactccatggtgagtccctctgtgttcggtgctgatcaccgacggaaacaccgccgacttctggtgctgggctcctctccagagctccccaaacccaacgagctcactctaaatcgagcaccggtcgtgtatatactgtctgatggcgcgagggaggcgatacg

SEQ ID NO: 792242 - DNA, 657 bp, Homo sapiens
  misc_feature: 47784.44.12.B01.1.pb.heavy.1.raw 47784
ctatgcgccttgccagcccgctcagacagtatataggaagtagtccttgaccaggcagccagggccgctgtgccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggcgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacaggtctcgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaatcgagcaccggtcgtgtatatactgtctgatggcgcgaggaggcgatacg

SEQ ID NO: 792243 - DNA, 558 bp, Homo sapiens
  misc_feature: 47787.UNK.UNK.UNK.pb.heavy.1.raw 47787
cgtatcgcctccctcgcgccatcagacagtatatacacgaccggtggctcgatttagactagcagtaagggggctgaggtgaagaagcctggggccctcagtgaaggtctcctgcaaggcttctggatacaccttcaccaattatgatatcaactgggtgcgacaggcactggacaagggcttgagtggatgggatggatgaacccctaacagtggtaaacacagtttgcagcagaagttccagggcagaggtcaccatgaccaggaacacctccataacacaggcctacatggagctgagcagcctgagatctgaggacacggccgtgtattactgtgcgagatcccgaaagtatagcagctcgtcggggaggtggttcgacccctgggggccagggaacctggtccccgtctcctcagcttccaccagggccccatcggtcttccccctgggcgccctgcctccaggagcacctctggggcacagcggccctggggctgcctggtcaagactacttcctatatactgttctgagcggggctggcaagggcgcatag

SEQ ID NO: 792244 - DNA, 610 bp, Homo sapiens
  misc_feature: 47812.UNK.UNK.UNK.pb.heavy.1.raw 47812
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacggtgaccgtggtccctttgccccagacgtccagatggtaagacttataatacagaaccagctgtttctttcccgcattacccgtgcacagtaatatgtgcctgtgtccgccagggtccatgttggtcatactaaagaccacctgccttttggaggtgtccttggagatggttaaactgctcttcagagatgtactgtaggatttttcgtcattcgagaagatgtgtgcaagccactccaggggccttccctgggggctgacggatccagctcacacccattctaatatcgttgagagagaaccagagatggtgcaggtcagcgtgagggtctctgtggggtttcaccagcacaggaccagactccttcaaggtgacctgggacaagaccccaagagagatcgtgacgcagcctaaatcgagcaccggtcgtgtatatactgtctgatggcgcgagggaggcgatacg

SEQ ID NO: 792245 - DNA, 682 bp, Homo sapiens
  misc_feature: 47830.UNK.UNK.UNK.pb.heavy.1.raw 47830
ctatgcgccttgccagccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccagtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaaactccatggtgagtcctctgtgttcagtcctgatcactgaatgaaaacacctggaatccaaggctggggctcctctcccagagctcaacacactctctctaaatcgagcacccggtcgtgtatatactgtctgatggcggcgagggaggcgatacg

SEQ ID NO: 792246 - DNA, 715 bp, Homo sapiens
  misc_feature: 47834.44.84.H07.1.pb.heavy.1.raw 47834
ctatgcgccttgccagcccgctcagacagtatataggaagtagtccttgaccagggcagcccagggccgctgtgcccccagaggtgctcttggaggaggtgccagggggaagaccgatgggcccttggtggaggctgcggcgacggtgaccagggctcctggcccaggagttgaaccacccacccactgtggatccagtccccccccctcttcgcacagaaataaagggccggtgtcttcgactctcaggctgttcatttccagaaaaaagtgtgtttccggaattgtctctggagatggtgaagcggcccttcacggactctccgtagtatgtgtcagttgcactagcgccaattgtcgagacccactcgagcccctttccctggagcctggcggaccaggtcatggcatagctcctaaaggggaagccagaggctgcacaggagagtctcagggaccccccaggctgtgccaatcctccccagactccaacagggccacctcacactggacaccttttaaaatagtcacaagaaaagccacctcagcccaaactccatggtgagtttctctctgttcagtcctgatcaccaaatgaaaacacctgaaaatcccagggctgggctcctctctcagagctccccgcgacagacgtctgctaaatcgagcaccggtcgtgtatatactgtctgatggcgcgaggggaggcgatacg

SEQ ID NO: 792247 - DNA, 622 bp, Homo sapiens
  misc_feature: 47857.44.23.C01.1.pb.heavy.1.raw 47857
ctatgcgccttgccagccgctcagacagtatataggaagtagtcctgaccaggcagcccagggccgctgtgcccccagaggtgctcctggagcagggcgccagggaagacgatgggcctgtggagctgaggagacagtgaccaggggggcacggcccctagatgaaagcagtctcgctcgccagaataaacggccgtgtccgcggcggtcacggaggtcagttcagggagaagcggttcatgacgtgtcctcgaaatggtgagacgactcttgagggacggagagtagtacgtcgcccccagtataatggatgtcaccaatcactccattccctccctggggctgccggatccagccccaagaatgatcagaactgatggaaactccagagacagtgcgatgagagacaggttcccgaaggcctcccagtcctggcccgactcctgcagctgcacctgggacaggacccatctggagctgccaccagcaggaggaaaaccacaggtgcttcatgttcttgcacagaggtccttgactctcagaaagccccaatcctaatcacgtgtactaaatcgagcaccggtcgtgtatatactgtctgatggcgcgaggaggcgatacg

SEQ ID NO: 792248 - DNA, 692 bp, Homo sapiens
  misc_feature: 48024.UNK.UNK.UNK.pb.heavy.1.raw 48024
ctatgcgccttgccagccgctcagacagtatataggaagtagtccttgaccaggcagcccagggccgctgtgctctcggaggtgctcctggagcagggcgccagggggaagaccgatgggcccttggggagctgaggagacggtgaccaggggttccctggccccagtagtcaagcggggaccgtctcgagggggctctcgcacaataatgacagccgtgtcctcacttgtggaggttgtacatttgcagatgcagtgtgttcctggattgtctctggagacggtgaatcggcccttctcggagtctccgtagtgttcttcaattccatcttctgatataattgccacccactccagccccttgctggagcctggcggacccagtgcatggcataggtcctgaagatgaatccagaggctgcacaggagagtctcagggagttcccaggctgggccgctcctccccagactccactagctgcacctggacactggccacctcttaaagagcaacgaggaaaacccatctcagcccaaagtccatggtgagtcctctgtgttcagtgatgatcaccgaatggaaacaccggtcgacttccagtgctgggctcgtctccccccctgagcgtagagcaaatcgagcaccggtcgtgtatatactgtctgatggcgcgagggaggaggcgattacg

SEQ ID NO: 792249 - DNA, 623 bp, Homo sapiens
  misc_feature: 48038.44.38.D05.1.pb.heavy.1.raw 48038
ctatgcgccttgccagcccggctccagacagtatataggaagtagtccttgaccaggcagcccaggccgctgtgcccccagaggtgctcctggagcagggcgccagggggaagaccgatgggcccttggtggaagctgaggagacggtgaccgtggtcccttggcccccagacgtccataccccgtagtagtagtatgcaactccccgaactcccgcaccggctcttgcacagtaatacacagccgtgtcctcggctctcagactgttcatttgcagatacagcacctgtccttgcgtttgtctctggagatggtgaatcggcccttcacgggagtccgcgtagcttgtgctactcccatcactattaatacgtgagacccacaccagccccttcctggagcttggcgggacccagtgcatccagtagctactgaaggtgaatcagaggctgcacaggagagtctcaggacccccaggctgaactaagcctcccccggactcaccagctgcacctcacactggacagccttttaaaatagcaacaaggaaaacccagctatcagatactaaatcgagcaccggtcgtgtatatactgtctgatggcgcgagggaggcgatacg

SEQ ID NO: 792250 - DNA, 700 bp, Homo sapiens
  misc_feature: 48078.44.55.E11.1.pb.heavy.1.raw 48078
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 792251 - DNA, 659 bp, Homo sapiens
  misc_feature: 48106.44.23.C01.1.pb.heavy.1.raw 48106
ctatgcgccttgccagcccgctcagacagtatataggaagtagtccttgaccaggcagcccagggccgctgtgcccccagaggtgctcctggagcaggggcgccagggggggaagaccgatgggcccttgtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccgccccagtataatggatgtcaccaatccactccattcccctccctggggctgccggatccagccccaagaatgatcagaactgatggaaactccagagacagtgcagatgagagacagggttcccgaaggcctcaccagtcctgggccccgactcctgcagctgcacctgggacaggacccatctgggagctgccaccagcaggagaaaaaccacaggtgcttcatgttcttgcacaggagggtccttgactctcagaaagcccccaatccctaatcacgtgtactaaatcgagcaccggtcgtgtatatactgtctgatggcgcgaggagggcgatacg

SEQ ID NO: 792252 - DNA, 692 bp, Homo sapiens
  misc_feature: 48107.44.27.C05.1.pb.heavy.1.raw 48107
ctatgcgccttgcagcccgctcagacagtatataggagtagtccttgaccaggcagcccagggccgctgtgctctcggaggtgctcctggagcagggcgccaggggaagaccgatggcccttggtggaggccgaggagacggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagccctcgcctggagcctggcggacccactgcatattccaattatcgaaggtgaatccagagctgcacaggagagtctcagggaccccctactggggccacgcctcccccagactccacgaattgcacctgacacatgacacctcttaagagggcaacgagaaacccagctcagcccaaactccatggtgagtcctctgtgttcagtgatgatcaccgagtggaaacaccggcgacttccagtgctgggctcgtctcccagcccaaacccttcgatcgcgtctaaatcgagcaccggtcgtgtatatactgtctgatggcgcgagggaggcgatacg

SEQ ID NO: 792253 - DNA, 707 bp, Homo sapiens
  misc_feature: 48131.UNK.UNK.UNK.pb.heavy.1.raw 48131
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctccagggaccccctactggggccacgcctccccagactccacgaattgcacctgacacatgacacctcttaagagggcaacgaggaaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccgggtcgtgtatatactgtctgatggcgcgaggggaggcgatacg

SEQ ID NO: 792254 - DNA, 707 bp, Homo sapiens
  misc_feature: 48158.44.55.E11.1.pb.heavy.1.raw 48158
cgtatcgcctcctcgcgccatcagtctatactatcacgaccggtgctcgatttagcactcgcacgttgggttttgggggggagaggagcccagcactgggattccgaggtgtttccattcggtgatcagccactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggcctgagtggggtctcagtcatttatactggtgatttcacatactacgcagactccgtgaagggcccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaaggcccatcggtcttccccctggcaccctctccagagcacctctggcgggcacagcggccctgggctgcctggtcaaggactacttcctatatactgtctgagcgggctggcaaggccgcatag

SEQ ID NO: 792255 - DNA, 639 bp, Homo sapiens
  misc_feature: 48191.UNK.UNK.UNK.pb.heavy.1.raw 48191
ctatgcgccttgccagcccgctcagacagtatataggaagtagtccttgaccaggcagccagggccgctgtgctctcggaggtgctcctggagcagggcgccagggggaagaaccgatgggccctggtggaggctgatgagaacggtgaccctggattccctggcccagggttcgaagaagcccgtggtcattgtggtcatgaagtgggcacagaaatagtgcctgtgtccacagggtccacgttggtcaatgtaaggaccacctggttttggacgtgtccttcgtgagcgtgagtctggtcgtcagagaaggactatatcgtatatcgtcattccaataagtgagtgcgatcactccagggcctttccggggggctgccgcacccagacacgccctctccaggaggacgagtgagaagcctgagacggtgcaggtcagcgtgaggtctgtgtggtttcaccaaatgtagggccagaactctttcacggtgatctgggacaggccccatgaagggatggtcgcagcaggagcgtggagcaaagtgtgtccatggtggggcacaggagtccccttactgactcactaaatcgagcacggtcgtgtatatactgtctgatggcgcgagggaggcgattacg

SEQ ID NO: 792256 - DNA, 715 bp, Homo sapiens
  misc_feature: 48195.44.85.H08.1.pb.heavy.1.raw 48195
cgtatcgcctccccgcgccatcagacagtatatacacgaccggtgctcgatttagtatcactcagtcgcgggggctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctgggccaagggaccacggtcaccgtctcctcagcctccaccaagggcccatcggtcttcccctggcaccctcctccaagagcacctctggggcacagcggcctggctgcctggtcaaggactacttcctatatactgtctgagcgggctggcaaggcgcatag

SEQ ID NO: 792257 - DNA, 660 bp, Homo sapiens
  misc_feature: 48197.44.12.B01.1.pb.heavy.1.raw 48197
cgtatcgcctccctcgcgccatcagacagtatataccacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaaacccgtcctcaagagtcgagtcaccatatcagtagacacgtccagaacagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctggggcacagcggcctggctgcctggtcaaggactacttcctattatactgtctgagcgggctggcaaggcgcatag

SEQ ID NO: 792258 - DNA, 699 bp, Homo sapiens
  misc_feature: 48273.UNK.UNK.UNK.pb.heavy.1.raw 48273
ctatgcgccttgccagccccgctcagacagtatataggaagtagtccttgaccaggcagccagggccgctgtgctctcggaggtgctcctggagcagggcgccaggggaagaccgatgggccccttggtggaggctgaggagacggtgaccaggttccctggccccagtagtcaagcggggaccgtctcgaggggctctcgcacaataatagacagccgtgtcctcacttgtgaggttgtacatttgcagatgcagtgtgtcctggaattgtctctggagacggtgaatcggccccttctcggagtctccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaaagagcaacgagggaaaacccatctcagccccaaagtccatggtgagtcctctgtgttcagtgatgatcaccgaatggaaaacaccggcgacttccagtgctgggctcgtctccccccctgagccgtagagctaaatcgagcaccggtcgtgtatatactgtctgatggcgccgagggaggccgaatacg

SEQ ID NO: 792259 - DNA, 672 bp, Homo sapiens
  misc_feature: 48282.44.6.A06.1.pb.heavy.1.raw 48282
ctatgcgccttgccagcccgctcagacagtatataggaagtagtccttgaccaggcagcccagggccgctgtgcccccagaggtgctctggagcagggcgccagggggaagacgatgggcccttggtggaagctgaggtgacaatgaccagggttccctgcccccagatctcaaggctccatgcgagctgggggtacggacctctcgcacagtagtagacgccgtgtcgtcggatttcaaagaactcattgtcatggagactgtgtctgtgacttgtccgcggtaatcgtaattctgccccggaagtctcgtgcgtaggtgagtgagcaaaaagagggatgattccaccccatccactcaagcccttgtccagggcctggcgcacccagttgatggtataagtagtggaactggtagtacttccagaggcgcgtgcaggaaagggtcaccgaggaccaaggttgcggcattctagtccccagactgcaccagttgcaccagggactggacacctgttgctgctgccaccacaaagaggaacctccaggtccaagccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 792260 - DNA, 697 bp, Homo sapiens
  misc_feature: 48339.44.27.C05.1.pb.heavy.1.raw 48339
ctatgcgccttgccagcccgctcagacagtatataggaagtagtccttgaccaggcagcccagggccgctgtgctctcggaggtgctcctggagcagggcgccaggggaagaccgatgggccttgtggaggccgaggagacggtgaccagggtccctggccccaggcgtcgaatgaacgattttggaaacagatagtctcgcacaaaaatacacggccgtgtcctgaggtctcaggctgttcatttgaagagacactgtgttctcggaattgtctctgagaatggtgaatcggccctcaacggaatcaccgtagacttgatttccctccatgaaatgacacacctgccacccactccagcccctcgcctggagcctggcggacccactgcatattccaattatcgaaggtgatccagaggctgcacaggagagtctcagggaccccctactggggcacgctcccccagactccacgattgcaacctgacacatgacacctcttaagagggcaacgaggaaaaccagctcagcccaaacttccatggtgagtcctctgtgttcagtgatgatcaccgagtggaaacacggcgacttccagtgctgggctcgtctcccagggctcccaaaccctcgatcgcgtctaaatcgagcaccggtcgtgtatatactgtctgatggcgcgagggaggcgatacg

SEQ ID NO: 792261 - DNA, 647 bp, Homo sapiens
  misc_feature: 48378.UNK.UNK.UNK.pb.heavy.1.raw 48378
cgtatcgcctccctcgcgccatcagacagtatatacacgacggtgctcggattagtgctatagacttggttttggggatgctttctgagagtcaggaaccctcctgtgcaagaacatgaagcacctgtggtttttcctcctgctggtggcagctccagatggggtcctgtcccaggtgcagctgcaggagtcgggcccaggactgtgaggccttcgggaaccctgtctctcatctgcactgtctctggagtttccatcagttctgatcattcttggggctggatccggcagcccccagggagggggaatggagtggattggtgacatccattatactggggcgacgtactactctccgtccctcaagggagtcgtctcaccatttcgagggacacgtccatgaccgctctccctgaaaactgactccgtgaccgccggggacacggccgtttatttctgtgcgaggcgagactggtctttcaatcatgggccgtggcaccctggtcactgtctctcagcttcaccaagggcccatcggtcttccccctggcgccctgctccaggagcactctggggcacagcggccctgggctgcctggtcaagactacttcctatatagctgtctgagcggcgggcaagggcatag

SEQ ID NO: 792262 - DNA, 657 bp, Homo sapiens
  misc_feature: 48387.44.12.B01.1.pb.heavy.1.raw 48387
cgtatcgcctccctcgcgccatcagacagtatatacacgaccggtgctcgattagtagtgtagattccgcgggggctttctgagagtcatggacctcctgtgcaagacatgaagcacctgtggttcttcctcctgctggtggcggctcccagatgggtcctgtcccagctgcagctgcaggagtcgggcccaggactggtgaagccttcggagacctgtccctcacctgcactgtctctggtggctccatcagcagtagtagttactactgggctggatccgccagccccagggaaggggctggagtggattgggagtatctattatagtgggagcacctactacaacccgtccctcaagagtcgagtcaccatatcagtagacacgtccaagaaccagttctccctgaagctgagctctgtgacgccgcggacacggccgtgtattactgtgcgagagtagggcagttcgtcaccactactttgaccactggggccagggaaccctggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 792263 - DNA, 704 bp, Homo sapiens
  misc_feature: 48391.44.67.G01.1.pb.heavy.1.raw 48391
ctatgcgccttgcagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtatagacgggccgtgtcgtcgcctctcaggttgttcatttgaagataaaccgtgttcctggaattgtccctggagatggtgaatcggcccttcacggagtctgcgtagtatgtgaaatcaccagtataatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaacacctcggaatcccagtgctgggctcctctcccccccaaacccaatatgtatactctaaatcgagcaccggtcgtgtatatatactgtctgatggcgcgagggaggcgatacg

SEQ ID NO: 792264 - DNA, 731 bp, Homo sapiens
  misc_feature: 48398.44.33.C11.1.pb.heavy.1.raw 48398
ctatgcgccttgccagcccgctcagacagtatataggaagtagtccttgaccaggcagcccagggccggctgtgccccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcatccatataagtgccacccactccagtcccttgcctggagcctggcggacccagtgcatgccatgtctggttgaaggtgaatccagacgctacacaggagagtctcagggacctcccaggctggaccacgcctcccccagactccaccagcttcacctgacactggacacctcttaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 792265 - DNA, 708 bp, Homo sapiens
  misc_feature: 48400.UNK.UNK.UNK.pb.heavy.1.raw 48400
ctatgcgccttgccagccgcctcagaccagtatataggaagtagtcctgaccaggcagcccaggccgctgtgctctcggaggtgctcctggagcagggcgccaggggaagaccgatgggcccgtggtggaggcccgaggagacggtgacagggttcctggcccgggccaggcgtccgaatgcaaccgattttggaaacagatagtctcgcacaaaaatacacggccgtgtcctgaggtctcaggctgttcatttgaagagacactgtgttctcgaattgtctctggagatggtgaatcggcccctcaacgaatcaccgtagaccttgatttcctccatgaatgacacacctgcccacccactcagccccgctggagcctggcggacccactgcatattccaattatcgaagtgatcccagaggctgacacaggagagtctcagggaccccccctactggggccacgcctcccccagactccacgaattgcactgacacatgacacctcttaagagggcaacgaggaaaacccagctcagcccaaactccatggtgagtcctctgtgttcagtgatgatccaccgagtggaacaccggcgacttccagtgctgggctcgtctcccagggctcccccaaacccttcgatcgcgtcaaatcgcgcacgggtcgtggatatactgtctgatggggcgagggaggcgattacg

SEQ ID NO: 792266 - DNA, 609 bp, Homo sapiens
  misc_feature: 48401.UNK.UNK.UNK.pb.heavy.1.raw 48401
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgccatgctagacgacaatatgaatctgcgggacccctagtggccaagatggccgctagcgggttccgcagcttttgacctggaccagggtgcatagcctgcccagccttc

SEQ ID NO: 792267 - DNA, 725 bp, Homo sapiens
  misc_feature: 48406.44.33.C11.1.pb.heavy.1.raw 48406
cgtatcgcctccctcgcgccatcagacagtatatacacgaccggtgctcgatttagagtgagctcgttgggtttggggagctctggagaggagcccagcaccagaagtcggcggtgtttccagtcggtgatcagcaccgaacacagaggactcaccatggagtttgggctgacctgggttttcctcgttgctcttttaagaggtgtccagtgtcaaggtgaagctggtggagtctggggaggcgtggtccagcctgggaggtcctgagactctcctgtgtagcggtctggattcaccttcaacagacatggcatgcactggtccgccaggctccaggcaaggactggagtgggtggcacttatatggtatgatggaagtaataaaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaaggaccacggtcgccgtctcctcagcctccacaagggcccatcggtcttccccctggcaccctcctccaagagcacctctgggggcacagcggccctgggctgcctggtcaaggactacttcctatatactgtctgagcgggctggcaagcgcatag

SEQ ID NO: 792268 - DNA, 695 bp, Homo sapiens
  misc_feature: 48408.44.36.D03.1.pb.heavy.1.raw 48408
ctatgcgccttgccagcccgctcagacagtatataggaagtagtccttgaccaggcagcccagggccgctgtgctctcggaggtgctcctggagcagggcgccagggggaagacgatgggccttggtggaggctgaggagacggtgaccaggggttccctggccccagtggacagttcctgatataaacacaacacaataatacatgccgtgtcctcggttttcaggttagtcattcgcagaatcaatgagttcttgaagtcatctcttgagaggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgcgagggaggcgatacg

SEQ ID NO: 792269 - DNA, 696 bp, Homo sapiens
  misc_feature: 48415.44.36.D03.1.pb.heavy.1.raw 48415
ctatgcgccttgccagcccgctcagacagtatataggaagtagtccttgaccaggcagcccagggccgcgctgtgctctcggaggtgctcctggagcagggcgccagggggaagaccgatggcccttggtggaggctgaggagacgggtgaccaggggttccctggccccagtggacagttcctgatataaacacaacacaataatacatgcccgtgtcctcggttttcagttagtcattcgcagaatcaatgagttcttgaagttcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaataacaacaaggaaaacccagctcagccgaactccatggtgagtcctctgtgttcagtgctgatcaccaaatgaaaacacctgggaattcgggctggggctccgctctccccaagagagatcgtgacgcagctaaatcgagcaccggtcgtgtatatactgtctgatggcgcgagggaggcgatacg

SEQ ID NO: 792270 - DNA, 698 bp, Homo sapiens
  misc_feature: 48421.44.55.E11.1.pb.heavy.1.raw 48421
ctatgcgccttgccagcccgctcagacagtatataggaagagtcttgaccaggcagcccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgtcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggcgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 792271 - DNA, 586 bp, Homo sapiens
  misc_feature: 48426.44.78.H01.1.pb.heavy.1.raw 48426
cgtatcgcctccctcgcgccatcagacagtatatacacgaccggtgctcgattagtgtgagtagtttgggtttggggggagaggaagactgacggtccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctcccaggtacagtctacatggaactgagcagcctgagatctgaggacacggccgtgtatttctgtgcgagagccaccagcacctggctgacttgtggggccagggaaccctggtcaccgtctcctcagcctccaccaagggcccatcggtcttccccctggcgccctgctccaggagcacctccgagagcacagcggccctgggctgcctggtcaagaactacttcctatatactgtctgagcgggctgcaaggcgcatag

SEQ ID NO: 792272 - DNA, 607 bp, Homo sapiens; identical to SEQ ID NO: 791936
  misc_feature: 48431.UNK.UNK.UNK.pb.heavy.1.raw 48431

SEQ ID NO: 792273 - DNA, 711 bp, Homo sapiens
  misc_feature: 48452.44.73.G07.1.pb.heavy.1.raw 48452
cgtatcgcctccctcgcgccatcagacagtatatacacgaccggtgctcgattttagctctacgctcaggggagctctgggagaggagcccagcactagaagtcggcggtgtttccattcggtgatcagcactgaacacagaggactccaccatggagttttgggctgagctggggttttcctcgttactcttttaagaggtgtccagtgtcaggtgcaccttggtggagtctggggggaggcgtggtccaagcctgggaggtcctgagactctcctgtgaagcctctgggatttagtttcagtagttctggcatggcacttgggtccgccaggctcccaggcaaggggccggagtggttggcagttataagcatatgatggaacttctagatattatgcagactccgtgaaggccgattcaccatctccagagacaattcccggaacactctgtacctggaaatgatcagcctgagaggcgaggactcggctctgtattactgtgcgagatcgggaagtggcagcagctattatcgggcgtttcactgggccaggggacactggtcaccgtctcctcagcctccaccaagggcccatcggtcttcccctggcgccctgctccaggagcacctccgagagcacagcggccctggctgcctggtcaaggactacttcctatatactgtctgagcggctggcaaggcgcatag

SEQ ID NO: 792274 - DNA, 703 bp, Homo sapiens
  misc_feature: 48453.UNK.UNK.UNK.pb.heavy.1.raw 48453
cgtatcgcctccctcgcgccatcagacagtatatacacggaccggtgctcgatttagacgcgatcgaagggtttggggctgggagacgagcccagcactggaaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcgtctcccctggcgccctgctccaggagcacctccgagagcacagcggcctgggctgcctggtcaaggactacttcctatatactgtctgagcgggctggccaaggcgcatag

SEQ ID NO: 792275 - DNA, 693 bp, Homo sapiens
  misc_feature: 48458.44.71.G05.1.pb.heavy.1.raw 48458
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacaccttctaaaaaaactacaaggaaaatcagattagcccaaactccatggttggtggtctgtgctcagtgctgatcaccaagtggaaactcctgggaatctcacggctggggctcctctctcttgcgacgacactaaatcgagcaccggtcgtgtatatactgtctgatggcgcgagggaggcgatacg

SEQ ID NO: 792276 - DNA, 674 bp, Homo sapiens
  misc_feature: 48483.44.6.A06.1.pb.heavy.1.raw 48483
cgtatcgcctccctcgcgccatcagacagtatatacacgaccggtgctcgatttagatctactgacaaccacattcctcctctaaagaagcccctgggagcacagctcatcaccatggactggacctggaggttccttctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcgtcttccccctggcgccctgctccaggagcacctctgggggcacagcggccctgggctgcctggtcaaggactacttcctatatactgtctgagcgggctggcaaggcgcatag

SEQ ID NO: 792277 - DNA, 708 bp, Homo sapiens
  misc_feature: 48489.UNK.UNK.UNK.pb.heavy.1.raw 48489
ctatgcgccttgcagcccgctcagacagtatataggaagtagtccttgaccaggcagcccagggccgctgtgctctcggaggtgctcctggagcagggcgccagggggaagaccgatgggcctttggtggagggctgaaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcaagagctccccaagagagatcgtgacgcagctaaatcgagcaccgggtcgtgtatatactgtctgatggcgcgagggaggcgatacg

SEQ ID NO: 792278 - DNA, 715 bp, Homo sapiens
  misc_feature: 48500.UNK.UNK.UNK.pb.heavy.1.raw 48500
cgtatcgcctccctcgcgccatcagacagtatatatacacgaccggtgctcgatttagcctctacgctcagggggggagacgagcccagccactgaagtcgccggtgtttccattcggtgatcatcactgaacacagaggactcaccatggactttggctgagatggggttttcctcgttgctcttttaagaggtggcccagtgtcaggtgcagctagtggagtctggggagcggagcggcccagcctgggaactccctgagactctcctgtgcagcctctggattcatcttcaggacctatgccatgcactgggtccgccaggctccaggcaagggctggagtgggtggcaattatatcagaagatggaattgaagaacactacggagactccgagaagggccgattcaccggtctccagagacaattccaggaacacactgcatctgcaaatgtacaacctcacaagtgaggacacggctgtctattattgtgccgagagccccctcgagacggtccccgcttgactactgggggcccagggaaccctgtcaccgtctcctcagcctccaccaagggcccatcgtcttccccctggcgccctgctccagcgagcacctcccgcagcagcacagccggcggccccgggctgctcgctggtccaagccggactacttcctatgatactgtctgagcgggctggcaaggcgcatag

SEQ ID NO: 792279 - DNA, 729 bp, Homo sapiens
  misc_feature: 48502.44.33.C11.1.pb.heavy.1.raw 48502
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctcccaaacccaacgagctcactctaaatcgagcaccggtcgtgtatatactgtctgatggcgcgagggaggcgatacg

SEQ ID NO: 792280 - DNA, 714 bp, Homo sapiens
  misc_feature: 48553.44.85.H08.1.pb.heavy.1.raw 48553
cgtatcgcctccctcgcgccatcagacagtatatacacgaccggtgctcgatttagtatcactcagtcgcggggagctctgggagaggagcccagcactagaagtcggcggtgtttcccaattcgtgatcagcactgaacacagaggactcaccatggagtttggctgagctgggttttcctcgttgctcttttaagaggtgtccagtgtcaggtggcagctggtggagtctggggaagggcgtggtccagcctggaggtccctgagacttctcctgtgcagcgtctggattcaccttcgtacctatggcatgcctgggtccgcaggctccaggcaaggggctggagtgggtggcacttatatggtatgatggaagtaataaatactatgcagactccgtgaaggccgattcaccatctcagagacaatccaagaacacctgtatctgcaaatgaacagcctgagagccgaggacacggctggtgtattactgtgcgcgaggacatatgtagtactaccacctgctggactactactacggtatggacgtctggggccaaggaccacggtcaccgtctctcagcctccaccaagggccatcggtcttcccctggcaccctcctccaagagcacctctgggggcacagcggcctgggctgcctggtcaaggactacttcctatatactgtctgagcgggctggcaaggcgcatag

SEQ ID NO: 792281 - DNA, 725 bp, Homo sapiens
  misc_feature: 48652.44.86.H09.1.pb.heavy.1.raw 48652
cgtatcgcctccctcgcgcatcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctggttttcctcgttgctctttaagaggtgtccagtgtcagtgaagctggtggagtctggggaggcgtggtccagcctgggaggtccctgagactctcctgtgtaggcgtctggattcaccttcaacagacatggcatgcactgggtccgccaggctccagcaaggactggagtgggtgcacttatatggtatgatggaagtaataaatattatgtagattccgtgaagggccgattcaccatctccagagacaattcgaagaacacactatatctggaaatgaatagcctgagagccggaggacacggctgtctaactactgtgcggagagatggggctcgtggatacagatatgacatgctctactccaatgtatggacgcctggggccaagggaccacggtcgccgtctcctcagcctccaccaaaagggcccatcggtcttcccctggcaccctcctccaagagcacctctgggggcacagcggccctgggctgccctggtcaagactacttcctatatactgtctgagcgggctggcaaggcgcatag

SEQ ID NO: 792282 - DNA, 592 bp, Homo sapiens
  misc_feature: 48653.UNK.UNK.UNK.pb.heavy.1.raw 48653
cccgacacgcttgctagggacttggagctaaggacgacatattgcctttagacagtcgaaggtgacgccttagctaccactgaacgtttaggcgccagatgcgtctgggatgacctaactcgcagctatcgatgatctactgcacgctcaaccaaccaggtcttgatgcgcgcgataggctgacgggatcgctcagacatttaactcgctagtaacttattggatcctaggatgggataggaaagaatccccctatcacccccccaatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagcttttgacctggaccagggtgcatagcctgccagccttc

SEQ ID NO: 792283 - DNA, 716 bp, Homo sapiens
  misc_feature: 48701.44.62.F07.1.pb.heavy.1.raw 48701
cgtatcgcctccctcgcgccatcagacagtatatacacgaccggtgctcgatttagtagtcgcataaaggggaaaggggagctctgagagaaggagcccagccctgggattttcagggtgtctgttcatttggtgaccaggaccgaacagagagaagtctccatggagtttgggctgagctgcctttttcttgtggcttttttaaaggtgtccgtgtgtgaagtgcagttgttggagtctggggggggcctgattcggcctgggaggtccctgaccctctcctgtgcggcctctggaattcacctttagtgcctatggcatgacctgaggtccgccgggctccagggagggactggagtgggatctcatagtcggagctggtggtgtcactttctacggagactcccgtgaagggccgcttcacatttccagggacaatttcgcaggacaaattgtttctccaaatgaaaaacctgagaccgagacacaggcgtcattactgtttgaaagccaggaccacggtgaccccccatggacacctttagtacttggggccgggggacagtggtgaccgtctcttcagcctccaccaagggcccatcggtcttccccttggcgccctgctccaggagcacctccgagagcacagcggccctgggctgcctggtcaggactacttcctatatactgtctgagcgggctggcaaggcgcatag

SEQ ID NO: 792284 - DNA, 602 bp, Homo sapiens
  misc_feature: 48713.UNK.UNK.UNK.pb.heavy.1.raw 48713
cccgacacgctgctagggacttggagctaaggacgacatatttgcctttagacagtcgaaggtgacgccttagctaccactgaacgtttaggcgccagatgcggtctgggatgacctaactcgcagcttatcgatgatctactgcacgctcaccaaaccaggtcttgatgcgcgcgaatagactgacggatcgctacagacatttaactcgctagtaacttaattggatcctaggggatggataggaaatagaatccacccctatcacccccccacatagcctgcttggggtgttgagtttacttttattcgtggttggaatgagttgaacttcccgggaagtgagtaatgggtttgttctacttccctaaccgcaaagtactagttttacgagtggcgttgcaaggccatagccagtcacaggtaataaacaattcaacgtggcgtaaagattggccgcttgctgtggcattgcaagctgggttgcagcattgtgcatgctagacgacaatatgaatctgcgggaccctagtggccagatggccgctagcgggttccgcagcttttgacctggaccagggtgcatagcctgcccagccttc

SEQ ID NO: 792285 - DNA, 750 bp, Homo sapiens
  misc_feature: 48735.UNK.UNK.UNK.pb.heavy.1.raw 48735
ctattgcagccttgccagcccgctcagacaatatatagaagtagtccttgaccaggcagcccaggggccgctgtgccccagagtgctcttggaggagggtgccagggggaagaccgatgggcccttggtggaggcggaggcgacggtgaccagggttccctggccccagaagtcaacacgaatacgtacataaccatccgagcgtccgacttgttcctcgcacaagaatagaacgacgccgtgtcgtcgcctactcaggttgttcatttgaatgataaacgtgttcctggaattgtcccatcggatggtgatgaaatcgagccgcttcacgacgaagtctgcgcgtagtatgtgacagatcagaccagtataaaatcactgagacccactcacagcccttcctgggagcctggcgggaccgcaactcatgtagttgccgagctgacggtgagcccagaggctgcacaggagagtctctggaccccccaggctggactaagcctccctccagactccatcagccgcacctcacactggacccttttaaaagtccaacaagagaaacccagctcagccaaaactccatggtgagtccctctgtgttcagtgctgatccaccgaatggaaacaccctcgatcccagtgcggagtgctcctctcccccccaaacccaacgtgcgagtgctaaatcgagcaccggtgcgtgatacgtatagactggattcggcgccgagggaggcgcgatacgag

SEQ ID NO: 792286 - DNA, 665 bp, Homo sapiens
  misc_feature: 48739.44.53.E09.1.pb.heavy.1.raw 48739
cgtatcgcctccctcgcgccatcagacagtatatacacgaccggtgctcgatttagagagagtgtgttgagctctgggagaggagccccagccttggaaattccaggtgttttcattcagtgatcagactgaacacagaggactcaccatggagtttgggctgagctggattttccttgctgctatttaaaaggtgtccagtgtgaggtgcagttggtggagtctggggaggtttggtaaagcctggggagtccttagactctcctgtgcagcctctggattcactttcagtaacgcctgatgacctgggtccgccaggctccaggaagggctggagtgggttggccgtattagaaccaagctgacgtggacagcagactacgctgcaccgtgaaagcagattcaccatctcaagagatgattcaaaagatacggtgtctctgcagatgaacagcctgaacaccgaggacacagccgtctattactgtctgggatggtttcattcggccagggaaccctggtcaccgtctcctcagcctccaccaagggcccatcggtcttccctggcgccctgctccagagcacctccgagagcacagcgccctggctgcctggtcaaggactacttcctatatactgtctgagcgggctggcaaggcgcatag

SEQ ID NO: 792287 - DNA, 704 bp, Homo sapiens
  misc_feature: 48752.44.27.C05.1.pb.heavy.1.raw 48752
cgtatcgcctccctcgcgccatcagacagtattatacacgaccggtgctcgatttagacgcgatcgaagggttggggctgggagacgagcccagcactggaagtcgccggtgtttccactcggtgatcatcactgaacacagaggactcaccatggagtttgggctgagctgggtttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792288 - DNA, 597 bp, Homo sapiens
  misc_feature: 48776.UNK.UNK.UNK.pb.heavy.1.raw 48776
gaaggctggcaggctatgcacctggtccaggtcaaagctgcggaacccgctagcggccatcttggccactaggggtcccgcagattcatattgtcgtctagcatgcacatgctgcaaacccagcttgcaatgcccacagcagcggccaatcttacgccacgttgaattgtttattacctgtgactggctatggctgcaacgccactcgtaaaactagtactttgcggttagggaagtagacaaacccattactccacttccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaacgttcagtggtagctaaggcgtcaccttcgactgtctaaaggcaatatgtcgtccttagctccaagtccctagcaagcgtgtcgg

SEQ ID NO: 792289 - DNA, 735 bp, Homo sapiens
  misc_feature: 48784.UNK.UNK.UNK.pb.heavy.1.raw 48784
ctatgcgccttgccagcccgctcagacaggtatataggaagtagtccttgaccaggcagcccagggccgctgttgcccccagaggtgctcttggaggagggtgccagggggaagaccgatggggcccttggtggaggctgaggagacggtgaccgtggtcccttggcccagacgtccataccgtagtagtgagtccagcaggtggtagtactacaatatgtcctcgcacagtaatacacagccgtgtcctcggctctcaggctgttcatttgcagatacagcgtgttcttggaattgtctctggagatggtgaatcggccccttcacgagtctgcatagtatttattacttccatcataccatataagtgccacccactccagccccttgcctggagcctggcggacccagtgcatgccataggtactgaaggtgaatcagacgctgcacagggagagtctcagggagcctcccaggctggaccacgcctccccccagactccaccagctgcacctgacactggacacctcttaaaagagcaagcgaggaaaacgccagctcagcccaaactccatggtgagtcctctgtgttcagtgctgatcaccgaatggaaacaccgcgccgacttctagtgctgggctcctctcccagagctcccgcgactgagtgatactaaatcgagcaccggctcgtgtatatacgctgtctgatgggcggcgagggaggcgatacg

SEQ ID NO: 792290 - DNA, 719 bp, Homo sapiens
  misc_feature: 48798.44.27.C05.1.pb.heavy.1.raw 48798
cgtatcgcctcctcgcgccatcagacagtatatacacgaccggtgctcgatttagacgcgatcgaagggtttgggggccctgggagacgagcccagcactgaagtcgccggtgtttttccactcgggtgatcatcactgaacacagagggactccaccatggagtttgggctgagctgcggtttctctccgttgcccctcttaagaggtgtcatgtgtccaggtgcattcgtggagtctggggggcgtggccccagtaggggcgtccctgagactctcctgtgcaggccttctggattcaccttcgataattggaatatggcaggtgggtctcgccagggctccaggcgagggctggagtgggtgcgcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcgcgttcattcgacgcctggggccagggaacccctggtcaccgtctcctcggcctccaccaaggggccatcggtcttccccctggcgcccctgctccaggagcacctccgagagcacagcggccctgggctgctggtcaaggactacttcctatatactgtctgagcgggctggcaaggcgcatag

SEQ ID NO: 792291 - DNA, 613 bp, Homo sapiens
  misc_feature: 48809.44.36.D03.1.pb.heavy.1.raw 48809
ctatgccgccttgccagcccgctcagacagtattataggaagtagtccttgaccaggcagcccagggccgctgtgccccagaggtgctcctggagcagggcgccagggggaagaccgatgggcccttggtggaagctgaggagacggtgaccgtggtcctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggaattttcgtcattcgagaagatgtgtgcaagccactccaggggccttccctgggggctgaacggatccaggctcgacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggagggcgatacg

SEQ ID NO: 792292 - DNA, 702 bp, Homo sapiens
  misc_feature: 48819.44.73.G07.1.pb.heavy.1.raw 48819
ctatgcgccttgccagcccgctcagacagtatataggaagtagtcttgaccaggcagcccagggccgctgtgctctcggaggtgctcctggaggcagggcgccaggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcaggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatggcgcgagggaggcgatacg

SEQ ID NO: 792293 - DNA, 715 bp, Homo sapiens
  misc_feature: 48821.UNK.UNK.UNK.pb.heavy.1.raw 48821
tcgtatcgcctccctcgcgccatcagacagtatatacacgaccgtgctcgatttagtagctctatcagggggagcatcacataacaaccacattcctcctctaaagaagccctggagcacaggctcatcaccatggactggacctggaggttcctctttgtggtggcagcagcaacaggtgtcccagtccctgggtgcaactggtgcgcagtctgggacctagaatgccccgcaacctttggtcctcgtgaccctttcctgcacggcctctggagtagtactaccagttccactacttataccatcaactggggtgcgccagggcccctggacaaggggctgaaggtggatgggtggaatcatccctctttttggctcactcacctacgcacgagacttccgggcagaattacgattaccgcggacaagtccacagacacagtctccatgacaatgagttctttgaaatccgacgacacgggccgtctactactgtgcgagaggtccgtacccccccagctcgcggcatggagccttttgagatctggggcagggaaccctggtcattgtcaccttcagcttccaccaagggcccatcggtcttccccccctggcgcgcctgctccaggagcacctctgggggcacagcggccctggctgcctggtcaaggactgacttcctatatactgtctgagcggctggcaaggcgcatag

SEQ ID NO: 792294 - DNA, 702 bp, Homo sapiens
  misc_feature: 48847.44.67.G01.1.pb.heavy.1.raw 48847
ctatgcgccttgccagccgctcagacagtatataggaagtagtccttgaccaggcagcccagggccgctgtgcccccagaggtgctcttgaggagggtgccagggggaagaccgatgggccctggtggagcggaggcgacggtgaccagggttccctgcccccagaagtcaaacgaataataaccactccgaccgcgccgacttgtctcgcacagtaatagacggccgtgtcgtccgcctctcaggttgttcatttgaagataaaccgtgttcctggaattgtcctggagatggtgaatcggccttcacggagtctgcgtagtatgtgaaatcaccagtataaatgactgagacccactccagccccttccctggagcctggcggacccaactcatgtagttgctgctgacggtgagcccagaggctgcacaggagagtctctggaacccccaggcggactaagcctcctccagactccatcagccgcacctcacactggacaccttttttaaaagtccaacaaggagaacccagctcagccaaaactccatggtgagtcctctgtgtttcagtgctgatcacgaatggaaacacctcggaatcccagtgctgggctcctctcccccccaaacccaatatgtatactctaaatcgagcaccggtcgtgtatatactgtctgatggcgcgaggaggcgatacg

SEQ ID NO: 792295 - DNA, 704 bp, Homo sapiens
  misc_feature: 48860.UNK.UNK.UNK.pb.heavy.1.raw 48860
ctatgcgccttgccagcccgctcagacagtatataggaagtagtccttgaccaggcagcccagggccgctgtgccccagaggtgctcttggagaggggtgccagggggaagaccgatgggccttggtggaggcggaggcgacggtgaccagggtttccctggccccagaagtcaaacgaataataaccactccgagcggccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaaacccagctcagccaaactccatggtgacgtcctctgtgttcagtgctgatcaccgaatggaaacaacctcggaatcccagtgctgggctcctctccccccaaacccaatatgtatactctaaatcgagcaccgtcggtatatactgtctgatggcgcgagggaggcgatacg

SEQ ID NO: 792296 - DNA, 692 bp, Homo sapiens
  misc_feature: 48911.44.62.F07.1.pb.heavy.1.raw 48911
ctatgcgccttgccagcccgctcagacagtatataggaagtagtccttgaccaggcagcccagggccgctgtgctctcggaggtgctcctggagcagggcgccaggggaagaccgatgggccttggtgaggctgaagagacggtcaccactgtccccgcccaagtactaaaggtgtcatggggtcaccgtggtcctggctttcaaacagtaatagacgcctgtgtcctcggtctcaggtttttcatttggagaaacaatttgtcctgcgaattgtccctggaaatggtgaagcgccctttcacggagtctccgtagaaagtgacacaccagctccgatactgagacccactccagtcccctccctggagccggcggacccaggtcatgccataggcactaaaggtgaatccagaggccgcacaggagagggtcagggacctccaggccgaatcaggcccccccagactccaacaactgcacttcacacacgacaccctttaaaaagccacaagaaaaaggcagctcagcccaaactcatggagacttctctctgttcggtcctggtcaccaaatgaagacactgaaaatcccagggctgggctcctctctcagagctcccctttccttatgcgactactaaatcgagcaccggtcgtgtatatactgtctgatggcgcgaggaggcgatacg

SEQ ID NO: 792297 - DNA, 698 bp, Homo sapiens
  misc_feature: 48971.UNK.UNK.UNK.pb.heavy.1.raw 48971
cgtatcgcccttcctcgcgccatcagacagtatatacacggacggtgctcgatttagcactcgcacgttgggtttgggagaggagcccagcactgggattccgaggtgtttccattcgtgatcagcactgaacacagaggactcaccatggagtttttggctgagctgggtctccttgttggacttttaaaaggtgtccagtgtgaggtgcggctgatggagtctggagagggcttagtcagcctggggggtcccagagactctcctgtgcagcctctgggctcaccgtcaggcagcaactacatgagttgggtcgccaggctccagggaagggctggagtgggtctcagtcattttactggtgatttcacatactacgcagactcccgtgaaggccgattcaccatctcccagggacaattccaggacacggtttatcttcaaatgaacaacctgagaggcgacgacacggccggtctattactgtgcgagacaagtcggcgctcgggagtggttattattcgtttgacttctggggccagggggaaccctggtcacccgtcgctccgcctccaccaagggcccatcgtcttcccctggcaccctcctccagcagcacctctgggcacagcggcctgggctgcctggtcaaggactacttcctatatactgtctgagcgggctggcaaggcgcatag

SEQ ID NO: 792298 - DNA, 608 bp, Homo sapiens
  misc_feature: 48975.UNK.UNK.UNK.pb.heavy.1.raw 48975
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgatagggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792299 - DNA, 606 bp, Homo sapiens
  misc_feature: 48978.UNK.UNK.UNK.pb.heavy.1.raw 48978
cccgacacgcttgctagggacttggagctaaggacgacatattgcctttagacagtcgaaggtgacgccttagctacactgaacgtttaggcgccagatgccggtctgggatgacctaactcgcaggcttatcgatgaatctactgcacgctcaaccaaaccaggtcttgatgcgcgcgataggactgacgggatcgctacagacatttaactcgctagtaacttaatgagatcctagggatgggataggaaatagaatccacccctatcaccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgccttgctgtgggcattgcaagctgggtttgcagcattgtgcatgctagacgacaatatgaatctgcgggaccctagtggccaagatgggccgctagcggttccgcagcttttgacctgaccagggtgcatagcctgcccagccttc

SEQ ID NO: 792300 - DNA, 683 bp, Homo sapiens
  misc_feature: 49018.UNK.UNK.UNK.pb.heavy.1.raw 49018
gcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccagggttccctggccccaggggtcgaaccaatttccatgttgggactatgagagggactatgaaagttgacgagggctctcgcacagaaatagatggccgtgtcttcagatctcagcctgctcagctccatgtaggctgtactcgtggattcgtccgcggtaatggtgactctgtcctgaaacttctgtgcgtaattcgatgcaccaaagatagggatgatccctcccagccactcagcccttgtccagggcctgtcgcacccaaataaaagcatagctgaagagtgcctccagaagccttgcaggagaccttcaccgaggacccaggcttcttcacctcagcccagactgcaccagctgcacctgggactggacacctgtagctgctgccaccacaaagaggaaccgccaggtccagtccatggtgatgagctgtgctccccagggcttctttagaggaggagtgtggttgttatgtgatcaaaatcgagcaccgtcgtgtatatactggtctgatggcgcgagggaggcgatacg

SEQ ID NO: 792301 - DNA, 710 bp, Homo sapiens
  misc_feature: 49040.UNK.UNK.UNK.pb.heavy.1.raw 49040
cgtatcgcctccctcgcgccatcagacattgtcatatacacgaccgcgtgctcgatttagtagctctatcaagggggagcatcacataacaaccacattcctcctctaaagaagccctgggagcacagctcatcacctggactaacaagacctgaggttcctctttgtggtggccagcagcaacaggtgtccagtccctggtgcaactggtgcagtctgggactagaatgccgcaacttggtcctcggtgaccctttcctgcacggcctctggagagtactaccagttccactacttatacatcaactgggtgcgccaggcccctggacaagggcttgagtggatgggtggaatcatccctcttttggctcactcacctcacgcacgagacttccgggccagaattacgattacgcgcgcgacaagtccgacagacacgagtctccatgacaatgagttctttgaaatccgcgacgacacggccgtctactactggcgagaggttccgtaacccagctcgcatggagcctttgagatctggggcaggaacacctggtcattgtcacctcagcttccaccaagggcccatcggtcctccccctggcgccctgctccaggagcactctggggcgcagcaggccggcccctggcctgcgcctggtcaaggactacttccttatactgtctgagcgggctggcaaggcgcatag

SEQ ID NO: 792302 - DNA, 643 bp, Homo sapiens
  misc_feature: 49047.UNK.UNK.UNK.pb.heavy.1.raw 49047
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaaagaccagtctcgcctcgcacagaaataaacggccgtgtccgcggcggtcacggaggtcagtttcagggagaagcggttcatggacgtgtcctcgaaatgtgagacgactcttgaggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcacagtcctggcccgactcctgcagctgcacctggacaggacccatctgggagctgccaccagcaggaggaaaaacacaggtgcttcatgttcttgcacagaggtccttgactctcagaaagccccaatccctaatcacgtgtactaaatcgagcaccgtcgtgtatatactgtctgatggcgcgagggaggcgatacg

SEQ ID NO: 792303 - DNA, 676 bp, Homo sapiens
  misc_feature: 49050.UNK.UNK.UNK.pb.heavy.1.raw 49050
cgtatcgcctcctcgcgccatcagacagtatatacacgacggtgctcgatttagctctacgctcagggggggagacgagcccagcactggaagtcgcggtgtttccattcggtgatcatcactgaacacagaggactcaccatggactttggctgagatgggtttcctcgttgctcttttaagaggtggccagtgtcaggtgcagctagtggagtctgggggaggagcggcccagcctgggaactcctgagactctcctgtgcaggcctctggattcatcttcaggactatgccatgcactgggtccgccaggctccaggcaggggctggagtgggtggcaattatatcagaagatggaattgaagaacactacggagactcgagaagggcgattcaccgtctccagagacaattccaggaacacactgcatctgcaaatgtacaacctcacaagtgaggacacgcgctgtctattattgtgcgagagccccctcgagacggtcccgcttgactactgggggccagggaaccctggtcaccgtctcctcagcctccacaaggccatcggtcttcccctggcgccctgctcaggagcacctccgagagcacagcggcctgggctgcctggtcaagactacttcctatatactgtctgagcggctgcaaggcgcatag

SEQ ID NO: 792304 - DNA, 705 bp, Homo sapiens
  misc_feature: 49067.44.27.C05.1.pb.heavy.1.raw 49067
cgtatcgcctccctcgcgccatcagacagtatatacacgaccggtgctcgatttagacgcgatcgaagggtttggggagccctgggagacgagcccagcactggaagtcgccggtgtttccactcggtgatcatcactgaacacagaggactcaccatggagtttggctgagctgggtttttcctcgttgccctcttaagaggtgtcatgtgtcaggtgcaattcgtggagtctgggggaggcgtgcccagtagggggtccctgagactctcctgtgcagcctctggattcacctcgataattggaatatgcagtgggtccgccaggcctccaggcgaggggctggagtgggtggcaggtgtgtcatttcatggaggaaatcaagtctacggtgattccgtgagggcccgatttccaccagtctccagagacaattccgagaacacagtgtctcttcaaatgaacagccctgagacctcaggacacggccgtgtattttgtgcgagactatctgttccaaatcggttcattcgacgcctggggccagggaaccctggtcaccgtctcctcggcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 792305 - DNA, 606 bp, Homo sapiens
  misc_feature: 49077.UNK.UNK.UNK.pb.heavy.1.raw 49077
cccgacacgcttgctagggacttgagctaaggacgacatattgccttttagacagtcgaggtgacgccttagctaccactgaacgtttaggcgccagatgcggtctggatgacctaactcgcagcttatcgatgatctactgacgctcaaccaaccaggtcttgatgcgcgatagactgacgggatcgctacagaccatttaactcgctgtaacttattgagatcctagggagggataggaaatagaatccaccctatccaccccccgccacatagctgcttggggtgttgagttttacttttatttcttgttggaatgagttgaacttcgggaagtggagtaatgggtttgtctacttcccctaaccgcaaagtactagttttacgagtgcgttgcaagccatagccagtcacagcgtaaataaacacacgtgtcaaggcgtggcgtaaagattgccgcttgctgtgggcattgcaagctgggtttgcagcattgtgcatgctagacgacaatatgaatctgcgggacccctagtgccaagatggccgctagcgggttccgcagcttttgacctgaccagggtgcatagcctgcccagccttctc

SEQ ID NO: 792306 - DNA, 579 bp, Homo sapiens
  misc_feature: 49115.UNK.UNK.UNK.pb.heavy.1.raw 49115
cgtatcgcctccctcgcgccatcagacagtatatacacgaccggtgctcgatttagtgtggagtagtttgggtttgggtgccgaagttgctggaggtcacggtcaccacgctgctgaggtgaagaagcctggggcctcagtgacagtcttcctgcacggcttctggatacacgttcatcaattatgatattaactgggtgcgacaggccgctggacaagggctggagtggatgggatggatgaagccctatagtggcaacacgggctttgcccagaagttcaaaggcagagttagtatgaccaggagcacctccccaggtacagtctacatggaactgagcagcctgagatctgaggacacggccgtgtatttctgtgcgagagccaccagcacctggcttgactttgtggggccagggaaaccctggtccccgtctcctcagcctccacaagggcccatcggtcttccccctggcgccctgctccaggagcacctccgagagcacaggcggccctgggcctgcctggtcaaggactacttcctatatactgtctgagccgggctggcaaggcgcatag

SEQ ID NO: 792307 - DNA, 700 bp, Homo sapiens
  misc_feature: 49126.44.55.E11.1.pb.heavy.1.raw 49126
ctatgcgccttgccagcccgctcagacagtatataggaagtagtccttgaccaggcagcccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaagtccaacaaggagaacccagctcagccaaaactccatggtgagtcctctgtgttcagtgctgatcaccgaatggaaacacctcggaatcccagtgctgggctcctctcccaaacccaacgtgcgagtgctaaatcgagcaccggtcgtgtatatactgtctgatggcgcgagggaggcgatacg

SEQ ID NO: 792308 - DNA, 716 bp, Homo sapiens
  misc_feature: 49132.UNK.UNK.UNK.pb.heavy.1.raw 49132
ctatgcgccttgcagcccgctcagacagtatataggaaagtagtccttgaccaggcagcccagggccggctgtgctctcggaggtgctcctggagcagggcgccagggggaaggaccgatgggcccttggtggaggcctgaggagacggtgaccagggttccctggccccagtggacagttcctgatataaacacaacacaataatacatgcccgtgtcctcggttttcaggttagtcattcgcagaaatcaatgagtttcttgaagtcatctctgagagggtgaatctggctttcacagacgcggcgtactctgtgataaagctggcaacctttgtttttactgcggccaagccactcccaagccccttcccctggagcctggcggacccagtccatatagtggtcactgatggtgaatccagaggcgacacaggagagtctcagggaccctcccaggctggaccaagtctcccccggactccaccaactgcacttcactctggacaccttgtaaaataacaacaaggaaaacccagctcagccccgaactccatggtgagtcctctgtgttcagtgctgatcaccaaatgaaaacacctgggaattctggggctggcggctccgctctcagagctccccaagagagatcgtggacgcagctaaatcgagcaccggtcgtgtatatactgtctgatgcgcgagggaggcgatacg

SEQ ID NO: 792309 - DNA, 675 bp, Homo sapiens
  misc_feature: 49136.UNK.UNK.UNK.pb.heavy.1.raw 49136
ctatgcgccttgccagcccgctcagacagtatataggaagtagtccttgaccaggccagccagggccgctgtgcccccagaggtgctcttggaggagggtgccagggggaagaccgatgggcccttggtggaggctgaggagacggtgaccaggcgttcctgccccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatcactcagtccttcccggcggactgccgcagccaactccaataataaactactgatgtaaccaccagagacattgcaggtgagggacagggtctccgaaggcttcacccgtctgggcccgactcctgcagctgcactcggacacgaccccatctgggaggtgccaccaggaggaggagaaccacaggtgttcatgttcttgtgccaggaggcccatgagtctcaagaaagtatccccaaaccaactaatcgtgtgctaaatcgagcaccggtcgtgtatatactgtctgatggccgcgaggaggcgatacga

SEQ ID NO: 792310 - DNA, 654 bp, Homo sapiens
  misc_feature: 49140.UNK.UNK.UNK.pb.heavy.1.raw 49140
cgtatcgcctccctcgcgccatcagacagtatatacacgaccggtgctcgaatttagtgctatagacttgggtttggggatgctttctgagagtcaaggacctcctgtgcaagaacatgaagcacctgtggtttttcctcctgctggtgcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcggccctgctccaggagcacctctgggggcacagcggccctgggctgcctggtcaaggactacttcctatatactgtctgagcgggctggcaaggcgcatag

SEQ ID NO: 792311 - DNA, 688 bp, Homo sapiens
  misc_feature: 49150.44.74.G08.1.pb.heavy.1.raw 49150
cgtatcgcctccctcgcgccatcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaaatgccgcaaccttggtcctcggtgaccctttcctgcacggcctctggaagtactaccagttccactacttataccatcaactgggtgcgccaggcccctggacaagggcttgagtggatggtggaatcatccctctttttggctcactcacctaacgcacgagacttccgggcagaattacgattaccgcggacaagtccacagacacagtctccatgacaatgagttctttgaaatccgacgacacggccgtctactactgtgcgagaggtccgtacccagctcgcatggagccttttgagatctgggggcagggaaccctggtcattgtcacctcagctccaccaagggcccatcgtcttcccctggcgccctgctccaggagcacctctgggggcacagcggccctgggctgcctggtcaagactacttcctatatactgtctgagcggctggcaaggcgcatag

SEQ ID NO: 792312 - DNA, 689 bp, Homo sapiens
  misc_feature: 49184.44.36.D03.1.pb.heavy.1.raw 49184
cgtatcgcctccctcgcgccatcagacagtatatacacgaccggtgctcgatttagctgcgtcacgatctctcttggggagagcggagccccagcccagaattcccaggtgttttcatttggtgatcagcactgaacacagagggactcaccatggagttcgggctgagctgggttttccttgttgttattttacaaggtgtccagagtgaagtgcagttggtggagtccggggagactttggtccagcctggagggtccctgagactctcctgtgtcgcctctggattcaccatcagtgaccactatatggactggtccgccaggctccagggaaggggctggagtgcttggccgcagtaaaacaagttgccagctttatcacagatacgccgcgtctgtgaaagccagattcaccctctcaaagagatgactcaagaactcattgattctgcgaatgactaacctgaaaaaccgaggacacgggcatgtattattgtgttgtgtttatatcaggaactgtccactgggccagggaaccctggtcaccgtctcctcagcctccaccaagggcccatcggtcttcccctggcgccctgctccaggagcacctcgagagcacagcggcctgggctgcctggtcaaggactacttcctatatactgtctgagcggctggcaaggcgcatag

SEQ ID NO: 792313 - DNA, 672 bp, Homo sapiens
  misc_feature: 49192.44.53.E09.1.pb.heavy.1.raw 49192
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccgaatgaaagccatccagcagtaatagacggcctgtgtctcggtgttcaggctgtcatctgcagagacaccgtatctttgaatcatctcttgagatggtgaatctgcctttcacgggtgcagcgtagtctgctgtccaccgtcagctttgttctaatacggccaacccactccagccccttccctggagcctggcggacccaggtcatccaggcgttactgaaagtgaatccagaggctgcacaggagagtctaagggactccccaggctttaccaaacctcccccagactccaccaactgcaccctcacactggacaccttttaaaatagcagcaaggaaaatccagctcagcccaaactccatggtgagtcctctgtgttcagtcctgatcactgaatgaaaaacacctggaatcccaaggctggggctcctctccagagctcaacacactctctctaaatcgagcaccggtcgtgtatatactgatggcgcgagggaggcgatacg

SEQ ID NO: 792314 - DNA, 606 bp, Homo sapiens
  misc_feature: 49281.UNK.UNK.UNK.pb.heavy.1.raw 49281
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctgcgcctaaacgttcagtggtagctaaggcgtcaccttcgactgtctaaaggcaatatgtcgtccttagctccaagtccctagcaagcgtgtcggg

SEQ ID NO: 792315 - DNA, 603 bp, Homo sapiens
  misc_feature: 49300.UNK.UNK.UNK.pb.heavy.1.raw 49300
aggctgggcaggctatgcaccctggtccaggtcaaaagctgcggaacccgctagcggccatcttgccactaggggtcccgcagattcatattgtcgtctagcatgcacaatgctgcaaacccagcttgcaatgccacagcaagcggccaatctttacgccacgttgaattgtttattacctgtgactggctatggcttgcaacgccactcgtaaaactagtactttgcggttaggggaagtagacaaacccattactccacttccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatccccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 792316 - DNA, 671 bp, Homo sapiens
  misc_feature: 49344.44.6.A06.1.pb.heavy.1.raw 49344
ctatgcgccttgccagcccgctcagacagtatataggaagtagtccttgaccaggcagcccagggccgctgtgccccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggattcaaagactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcagaaagggtcaccgaggaccaaggttgcggcattctagtcccagactgcaccagttgcaccagggactggacacctgttgctgctgccaccacaaagaggaacctccaggtccagtccatggtgatgagctgtgctcccagggcttctttagaggaggaatgtggttgtcagtagatctaaatcgagcaccggtcgtgtatatactgtctgatggcgcgaggaggcgatacg

SEQ ID NO: 792317 - DNA, 689 bp, Homo sapiens
  misc_feature: 49368.UNK.UNK.UNK.pb.heavy.1.raw 49368
ctatgcgcctgccagcccgctcagacagtatataggaagtagtccttgaccaggcagccagggccgctgtgctctcggaggtgctcctggagcagggcgccaggggaagaccgatgggccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcgcgtactctgtgataaagctggcaactttgttttactgcggccaagccactccagccccttcctggagcctggcggaccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgactccatggtgattctctgtgttcagtgctgatcaccaaatgaaaacacctgggaattctggggctggggctccgctctcagagctccccaagagagatcgtgacgcagctaatcgagcacggtcgttatatactgtctgatggcgcgaggaggcgatacg

SEQ ID NO: 792318 - DNA, 704 bp, Homo sapiens
  misc_feature: 49372.UNK.UNK.UNK.pb.heavy.1.raw 49372
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggcccccaggcgtcgaatgaaccgattttggaaacagatagtctcgcacaaaaatacacgccgtgtcctgaggtctcaggctgttcatttgaagagacactgtgttctcggaattgtctctggagatggtgaatcggccctcaacggaatcaccgtagacttgatttcctccatgaaatgacacacctgccacccactcagcccctcgcctggagcctggcggacccactgcatattccaattatcgaaggtgaatccagaggctgcacaggagagtctcaggacccccctactggggccacgcctcccccagactccacgaattgcacctgacacatgacacctcttaagagggcaacgaggaaaaccccagctcagcccaaactccatggtgagtcctctgtgtcagtgatgatcaccgagtggaaacaccggcgacttccagtgctgggctcgtctcccaggccccaaacccttcgatcgcgtctaaatcgagcagccgcgtcgtgtatatactgtctgatggcgcgagggaggcgatacg

SEQ ID NO: 792319 - DNA, 726 bp, Homo sapiens
  misc_feature: 49378.44.33.C11.1.pb.heavy.1.raw 49378
cgtatcgcctccctcgcgccatcagacattatatacacgaccggtgctcgatttagagtgagctcgtgggtttggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtgagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792320 - DNA, 704 bp, Homo sapiens
  misc_feature: 49389.44.21.B10.1.pb.heavy.1.raw 49389
ctatgcgccttgccagcccgctcagacagtatataggaagtagtccttgaccaggcagcccagggccgctgtgccccccagaggtgctcctggagcagggcgccagggggaagaccgatgggcccttggtggaagctgaagagacggttgaccattgtcccctggccccaaaatatcaaatgcatcgacgtcccaggatcgcctggcgcaagtaatagacgcctgtgtcgtcgggttctcaggtttgctcatttgtaaatggccaacactgttggagtcatcccttgagacggtgaatctcccttcacagacgcggcgtactctttacttccaccataaacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaaatcaagattagcccaaactccatggtggtggtctgtgctcagtggctgattcaccaagtggaaaactcctgggaatctcacggctggggctccttctcttgcgacgacactaaatcgagcaccggtcgtgtatatactgtctgatggcgcgagggaggcgatacga

SEQ ID NO: 792321 - DNA, 707 bp, Homo sapiens
  misc_feature: 49396.44.55.E11.1.pb.heavy.1.raw 49396
ctatgcgccttgccagcccgctcagacagtatataggaagtagtccttgacccagggcgccaggcccgctgtgccccagaggtgctcttggaggagggtgccagggggaagaccgatggccttggtggaggcggaggcgacggtgaccagggttcccctggccccagaagtcaaacgaataataaccactccgagcgcccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggggaaacacctcggaatcccagtgctggggctcctctcccccccaaacccaacgtgcgagtgctaaatcgagcaccggtcgtgtatatactgtctgatggcgcgagggaggcgatacg

SEQ ID NO: 792322 - DNA, 555 bp, Homo sapiens
  misc_feature: 49418.UNK.UNK.UNK.pb.heavy.1.raw 49418
ctatgcgccttgccagcccgctcagacagtatataggaagtagtccttgaccaggcagcccagggccggctgtgccccagaggtgctcctggagcagggcgccagggggaagaccgatggcccttggtggaagctgaggagacggtgaccaggggttccctggccccaggggtcgaaccacctccccgacgagctgctatactttcgggatctcgcacagtaatacacggccgtgtcctcagatctccaggctgctcagctccatgtaggctgtgtttatggagggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggccccaggcttcttcacctcagccccttactgcctagtctaaaatcgagggcaccggtcgtgtatatactgtctgatggcgcgaggaggcgatacg

SEQ ID NO: 792323 - DNA, 558 bp, Homo sapiens
  misc_feature: 49439.UNK.UNK.UNK.pb.heavy.1.raw 49439
cgtaatcggccctcctcgcgccatcagacagggtatatacacgacggtgctcgatttagacgcgatcgaagggttttgggggaggcgtggccccagtaggggggtcctgagactctcctgtgcagcctctggattcaccttcgataattgggaatatgcagtgggtccgccaggctcccaggcgaggggctggagtggggtggcaggtgtgtcatttcatggaggaaatcaagtctacggtgattccgttgaggggccgattcaccatctccagagacaattccgagaacacagtgtctcttcaaatgaacagcctgagacctcaggacacggccgtgctatttttgtgcgagactatctgtttccaaaatcggttcatttcgacgcctggggccagggaaccctggtcaccgtctcctcggcctccaccaagggcccatcggtcttccccctggcgccctgctccaggagcacctccgagagcacagcggcgccctggcctgcctggtcaaggactacttcctatatactgtctgagcgggctggcaaggcgcatag

SEQ ID NO: 792324 - DNA, 686 bp, Homo sapiens
  misc_feature: 49446.44.45.E01.1.pb.heavy.1.raw 49446
ctatgcgccttgccagcccgctcagacagtatataggaagtagtccttgaccaggcagccccagggccgctgtgctctcggaggtgctcctggagcagggcgccagggggaaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggacacgcctcccccagacctccaccagctgaacctgacactggacacctcttaaaagagcaacgaggaaaacccagctcagcccaaactccatggtgagtcctctgtgttcagtgctgatcacgaatggaacaccgccgacttctagtgctgggctcctctcccagccccttttcccttactgactcactaaatcgagcaccggtcgtgtatatactgtctgatggcgcgcgagggaggcgatacg

SEQ ID NO: 792325 - DNA, 609 bp, Homo sapiens; identical to SEQ ID NO: 791339
  misc_feature: 49467.UNK.UNK.UNK.pb.heavy.1.raw 49467

SEQ ID NO: 792326 - DNA, 624 bp, Homo sapiens
  misc_feature: 49471.44.23.C01.1.pb.heavy.1.raw 49471
ctatgcgccttgccagcccgctcagacagtatataggaagtagtcccttgaccaggcagcccagggccgctgtgccccagagtgctcctggagcagggcgccagggggaagaccgatggccccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttttgagggacggagagtagtacgtcgccccagtataatggatgttcaccaaatccactccattcccctccctgggggctgccggatccagccccaagaatgatcagaactgatggaaaactccagagacagtgcagatgagagacagggttcccgaagggcctcaccagtctgggcccgactcctgcagctgcacctggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 792327 - DNA, 651 bp, Homo sapiens
  misc_feature: 49596.44.6.A06.1.pb.heavy.1.raw 49596
cgtatcgcctcctcgcgccatcagacagtatatacacgaccggtgctcgattagatctactgacaaacacatttcctcttaaagaagcccctgggagcacagctcatcaccatggactggacctggaggttcctctttggtggcagcagcaacaggtgtccagtccctggtgcaactggtgcagtctgggactagaatgccgcaccttggtcctcgtgacccttcctgcacgcctctggaagtactaccagttccactacttataccatcactgggtgcgccaggcccctggacaaggcttgagtggatgggtggaatcatccctcttttggccactcacctacgcacgagacttccgggcagaattacgataccgcggacaagtccacagacacagtctccatgacaatgagttctttgaaatcgacgacacggccgtctactactgtgcgagaggtccgtacccagctcgcatggagccttgagactgggggcagggaaccctggtcattgtcactcagcttccaccaagggcccatcggtcttcccctggcgccctgctccaggagcacctcggggcacagcggcctggctgcctggtcaagagactacttcctatatactgtctgagcgggctggcaaggcgcatag

SEQ ID NO: 792328 - DNA, 695 bp, Homo sapiens
  misc_feature: 49638.44.27.C05.1.pb.heavy.1.raw 49638
ctatgcgccttgccagcccgctcagacagtatataggaagtagtccttgaccaggcagcccagggccgctgtgctctcggaggtgctcctggagcagggcgccaggggaagaccgatggcccttggtggaggcgaggagacggtgaccaggttccctggcccaggcgtcgaatgaaccgattttggaaacagatagtctcgcacaaaaatacacggccgtgtcctgaggtctcaggctgttcatttgaagagacactgtgttctcggaattgttctctggagatggtgaatcggccctcaacggaatcaccgtagacttgatttcctccatgaaatgacacacctgccacccactccagccctcgccctggagcctggcggacccactgcatattccaattatcgaaggtgaatccagaggctgcacaggagagtctcagggaccccctactgggcacgcctccccagactccacgaattgcacctgacacatgacacctcttaagaggcaacgaggaaaacccagctcagcccaaactccatggtgagtcctctgtgttcagtgatgatcaccgagtggaaacaccggcgacttccagtgctgggctcgtctcccaggcccaaacccttcgatcgcgtctaaatcgagcaccggtcgtgtatatactgtctgatggcgcgagggaggcgatacg

SEQ ID NO: 792329 - DNA, 723 bp, Homo sapiens
  misc_feature: 49653.44.33.C11.1.pb.heavy.1.raw 49653
cgtatcgctccctcgcgccatcagacagtatatacacgaccggtgctcgatttagagtgagctcgttggtttggggagctctgggagaggagcccagcaccagaagtcggcggtgtttccagtcggtgatcagcaccgaacacagaggactcaccatggagtttggctgacctgggttttcctcgttgctcttttaagaggtgtccagtgtcaggtgaagctggtggagtctgggggaggcgtggtccagcctgggaggtccctgagactctcctgtgtagcgtctggattcacctcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggccaagggaccacggtcgccgtctcctcagcctccaccaagggcccatcggtcttccccctggcaccctcctccaagagcacctctgggggcacagcggcctgggctgcctggtcaaggactacttcctatatactgtctgagcggctggcaaggcgcatag

SEQ ID NO: 792330 - DNA, 694 bp, Homo sapiens
  misc_feature: 49669.UNK.UNK.UNK.pb.heavy.1.raw 49669
cgtatcgcctccctcgcgccatcagacagtatatacacgaccggtgctcgatttagtgagtcagttaagggaaagggggctggagaggagcccagcactagaagtcggcggtgtttccattcggtgatcagcactgaacacagccgcactcaccatggagtttgggctgagctgggttttcctcgcttgctttttaagaggctgtcccagtgtcagttcagctggtggagtctgggggagcggcgtggtccagcctggacgtccctgagactctcctgctgtttgcgtcggactcgccagttcagtgactctgccatgcactgggtccgccaggctccacggcacagggctggagtgggttggcagtcatctggtctgatggaagtaaagaatactatggaactccgtggagggccgattctccgtctccagagacaattccgaagaacaccgtgtatctacaaatgaacaatttgagagccgaggactcggctctctattattgtacgagccatcgttctactgggcgccagggagccctggtcacgcgttcctcagcctccaccaagggcccatccggtcttccccctggcgccctgctcaggagcacctccgagagcacagcggcgcctgggctgcctggtcaaggactacttcctatatacttgtctgagcgggctggcaaggcgcatag

SEQ ID NO: 792331 - DNA, 656 bp, Homo sapiens
  misc_feature: 49679.44.12.B01.1.pb.heavy.1.raw 49679
cgtatcgcctccctcgcgccatcagacagtatatacacgaccggtgctcgattagtagtgtagattccgcgggggctttctgagagtcatggaccttcctgtgcaagaacatgagcacctgtggttcttcctcctgctggtggcggctcccagatgggtcctgtcccagctgcagctgcaggagtcgggcccaggactggtgaagcttcggagaccctgtccctcacctgcactgtctctggtggctccatcagcagtagtagttactactggggctggatccgccagcccagggaaaggggctggagtggattgggagtatctattatagtgggagcacctactacaacccgtccctcaagagtcgagtcaccatatcagtagacacgtccaagaaaccagttctccctgaagctgagctctgtgaccgccgcggacacggccgtgtattactgtgcgagagtagggcagttcgtcaccactactttgaccactggggccagggaaccctggtcaccgtctcctcagctcccacaagggcccatcggtcttccccctggcaccctcctccaagagcaccttgggggcacagcgccctggctgcctggtcaggactacttcctatatactgtctgagcgggctggcaggcgcatag

SEQ ID NO: 792332 - DNA, 606 bp, Homo sapiens
  misc_feature: 49683.UNK.UNK.UNK.pb.heavy.1.raw 49683
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccaggtgcatagcctgcccagccttc

SEQ ID NO: 792333 - DNA, 706 bp, Homo sapiens
  misc_feature: 49687.44.55.E11.1.pb.heavy.1.raw 49687
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccaagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcaaccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792334 - DNA, 708 bp, Homo sapiens
  misc_feature: 49689.UNK.UNK.UNK.pb.heavy.1.raw 49689
ctatgcgccttgccagcccgctcagacagtatataggaagtagtccttgaccaggcagcccagggccgctgtgcccccagaggtgctcctggagcagggcgccagggggaagaccgatggcccttggtggaagctgaaagagacggtggaccattgtcccctggccccaatatcaaatgcatcgacgtccaggatcgcctggcgcagtaatagacgcctgtgtcgtcgggtctcaggttgctcatttgtaaatggccaacactgttggagtcatcccttgagacggtgaatcttccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacaccttctaaaaaaactacaaggaaaatcaagattagcccaaactccatggttggtggtctgtgctcagtgctgatcaccaagtggaaactcctgggaatctcacggctgggctcctctccagagctcccctttgtgtgttcagacgtctgctaaatcgagcaccgtcgtgtaatatactgtctgatggcgcgaggaggcgatacg

SEQ ID NO: 792335 - DNA, 700 bp, Homo sapiens
  misc_feature: 49691.44.36.D03.1.pb.heavy.1.raw 49691
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgagtccggggagacttggtccagcctggagggtccctgagactctcctgtgtcgcctctggattcaccatcagtgaccactatatggactggtccgccaggctccagggaagggctggagtggcttggccgcagtaaaaacaaagttgccagctttatcacagagtacgccgcgtctgtgaagccagattcacccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792336 - DNA, 599 bp, Homo sapiens
  misc_feature: 49698.UNK.UNK.UNK.pb.heavy.1.raw 49698
aggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggcaatctttacgccacgttgaattgtttattacctgtgactggctatggcttgcaacgccactcgtaaaactagtactttgcggttagggaagtagacaaacccattactccacttccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatccagacgcatctgcgcctaaacgttcagtggtagctaaggcgtcaccttcgactgtctaaaggcaatatgtcgtccttagctccaagtccctagcaagcgtgtcgg

SEQ ID NO: 792337 - DNA, 698 bp, Homo sapiens
  misc_feature: 49707.44.36.D03.1.pb.heavy.1.raw 49707
cgtatcggcctccctcgcgccatcagacagtatataccacgaccggtgctcgatttagctgcgtcacgatctctcttgggggagagcggagcccagccccagaattcccagggtgtttcattggtgatcagcactgaacacagaggactcaccatggagttcgggctgagctgggttttccttgttgttattttacaaggtgtccagagtgaagtgcagttggtggagtccgggggagacttggtccagcctggagggttccctgagactcttcctgtgtcgcctctggattcaccatcagtgaccactatatggactgggtccgccaggctccagggaaggggctggagtggcttggccgcagtaaaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggccctgggctgcctggtcaaggactacttcctatatactgtctggagcggcggcaggcgcatag

SEQ ID NO: 792338 - DNA, 672 bp, Homo sapiens
  misc_feature: 49721.44.12.B01.1.pb.heavy.1.raw 49721
cgtatcgcctccctcgcgccatcagacagtatatacacgaccggtgctcgatttagtagtgtagattccgcgggggctttctgagagtcatggacctcctgtgcaagaacatgaagcacctgtggtttcttcctcctgctggtggcggctcccagatgggtcctgtcccagctgcagctgcaggagtcgggcccaggactggtgaagcctttcggagaccctgtccctcacctgcactgtctctggtgggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgcccgcggacacggccgtgtattactgtgcgagaagtagggcagtttcgtcaccaactactttgaccactggggccaggaaaccctggtcaccgtctcctcagcctccaccaagggcccatcggtcttcccccctggcaccctcctccaagagcacctctgggggcacagcggccctgggctgcctggtcaaggactacttcctatatactgtctgagcgggctggcaaggcgcatag

SEQ ID NO: 792339 - DNA, 715 bp, Homo sapiens
  misc_feature: 49753.44.55.E11.1.pb.heavy.1.raw 49753
cgtatcgcctccctcgcgccatcagaacagtatatacacgaccggtgctcgatttagcactcgcacgttgggtttgggggagaggagcccagcactgggattccgaggtgtttccattcggtgattcagcactgaacacagaggactcaccatggagttttggctgagctgggttctccttgttggacttttaaaaggtgtccagtgtgaggtgcggctgatggagtctggaggaggcttagtccagcctggggggtcccagaagactctcctgtgcagcctctgggctcaccgtcagcagcaactacatgagtttgggtccgccaggctccagggaagggggctggagtggggtctcagtcatttatactggtgattttcacatactacgcagactccgtgaagggccgattcaccatctccagggacaattccaggaacacggtttatcttcaaatgaacaacctgagaggcgacggacacggccgtctattactgtgcgagacaagtcggcgctcggagtggtttattattcgttttgacttctgggggccagggaaccctggtcaccgtcgcctccgcctccaccaagggccatcggtcttcccctggcaccctcctccaagagcacctctgggggcacagcggccctgggctgcctggtcaaggactacttcctatatactgtctgaagcgggctggcaaggcggcatag

SEQ ID NO: 792340 - DNA, 570 bp, Homo sapiens
  misc_feature: 49772.44.78.H01.1.pb.heavy.1.raw 49772
ctatgcgccttgccagcccgctcagacagtatataggaagtagtccttgaccaggcagcccagggccgctgtgctctcggaggtgctcctggagcagggcgccagggggaagaccgatgggccttgtggaggctgaggagacggtgaccagggttccctggccccacaagtcaagccaggtgctggtggctctcgcacagaaaatacacggccgtgtcctcagatctcaggctgctcagttccatgtagactgtacctgggaggtgctcctggtcatactaactctgccttggaacttctgggcaaagccgtgtgccacttatgggcttcatccatcccatccactccagccttgtccagcggcctgtcgcacccagttaatatcataattgatgaacgtgtatccaggaagccgtgcaggagactgtcactgaggccccaggcttcttcacctcagcagccgtggtgaccgtgaccttccagcaacttcggcacccaaacccaaactactcacactaaatcgagcaccggtcgtgtatatactgtctgatggcgcgaggaggcgatacg

SEQ ID NO: 792341 - DNA, 688 bp, Homo sapiens
  misc_feature: 49775.44.72.G06.1.pb.heavy.1.raw 49775
cgtatcgcctccctcgcgccatcagacagtatatacacgaccggtgctcgatttagctacgactgcaaggaaaggggagagaggagccttagccctggactccaaggcctttccacttggtgatcagcactgagcacagaggactcaccatggaattgggactgagctgggtttccttgttgctattttagaaggtgtccagtgtgaggtgcaactggtggagtctgggggaggcttggtccagcctggggggtccctgagactctcctgtgcagcctctggattcacctttagtagttattggatgaactgggtccgccaggctccaggaaggggctggagtgggtggccatcatgaagaaagatggaactgagacacactatgtggactctgtgaagggccgattcaccatctccagagacaacgccaagaactcactgtatctgcaaatgaacagtctgagagtcgaggaccacggctgtgtattattgtgcgggaggcgctgggtggctcattgactactggggtcagggaaccctggtcaccgtctcctcagcctccaccaagggccatcggtcttccccctggcgcctgctccaggagcacctccgagagcacagcgccctgggctgcctggtcaaggactacttcctatatactgtctgagcgggctggcaaggcgcatag

SEQ ID NO: 792342 - DNA, 1375 bp, Homo sapiens
  misc_feature: 49809.UNK.UNK.UNK.pb.heavy.1.raw 49809
cgtatcgcctcctcgcgccatcagacagtatatacacgaccggtgctcgatttagcactgcacgttgggtttggggggggagaggagcccagcactgggattccgagtgtttccattcggtgatcagcactgaacacagaggactcaccatggagttttggctgagctgggttctccttgttggacttttaaaggtgtccagtgtgaggtgcggctgatggagtctggaggaggcttagtccagcctggggggtcccagagactctcctgtgcaggctctgggctcaccgtcagcagcaactacatgagttgggtccgccaggcccagggaaagggctggagtgggtctcagtcatttatactggtgatttcacatactacgcagactccgtgaaggccgattcaccatctccagggacaaattccaggaacacggtttatcttcaaatgaacaacctgagaggcgacgacacggccgtctattactgtgcgagacaagtcggcgctcggagtggttattattcgtttgacttctggggccaggaaccctggtcaccgtcgcctcgcctccaccaagggcccatcggtcttcccccggcaccctcctccaagagcacctctgggggcacagcggccctgggctgcctggtcaagactactatatactgtctgagcgggctggcaaggcgcatagcgtatcgcctccctcgcgccatcagacagtatatacacgaccgtgctcgatttagtgtgagtagtttgggttgggagctctgggagaggagccccgccttggattcccaggtgttttcattcagtgatcaggactgaacacagaggactcaccatggagtttgggctgagctggattttccttgctgctattttaaaaggtgtccagtgtgaggtgcagttggtggagtctggggggaggttggtaaagcctggggagtccttagactctcctgtgcagcctctggattcactttcagtaacgcctggatgacctgggtccgccaggctccaggaaggggctggagtgggtggccgtattagaaccaagctgacgggggacagcagactacgctgcacccgtgaaaggcagattcaccatctcaagagatgattcaaaaagatacggtgtctctgcaggatgaacagcctgaacaccggagacacagccgtctattactgtctgggatggtttcattcgggcagggaaccctggtcaccgtctcctcagcctccaccaagggcccatcggtctttcccctggcgccctgctccaggagcacctccggaagcacagcgcccttgggctgcctggtcaaggactacttcctatatactgctgaagcggctgcaaggcgcatag

SEQ ID NO: 792343 - DNA, 688 bp, Homo sapiens
  misc_feature: 49811.UNK.UNK.UNK.pb.heavy.1.raw 49811
cgtatcgcctccccgcgccatcaacagtatatacgacggtgctcgatttagtgacatctcgcagtctttgggggagagacgagcccagcactggaagtcgccggtgtttcattcggtgatcatcatgaacacagagactcaccatggagtttggctgagctggtttcctcgttgctcttttagaggtgtccaggtgtcaggacacttgtggatctggcgtggcccgccggaggcctgagactctcctgtgtagcctctgggttctcattcgatgatttggtttgcactgggtcgccaggctccaggcaaggggccggagtgggtggcagtcattctcgacgatggaagtgagaagtattatcagactccgtgaagggccgatcaccatcccagaggacattcaagatatgctgtattgcaaaatgaacagcgtgagagttgacgacacgtctgtttattactgtgcgagggggacctcaggaaacggttcgggaatctaaactactactattgatggatgtctggcgggggacgtcggtcaccgtctcctcagcttccaccaagggcccatcggctcttccgcctggcgcctgctccaggagcacctctggggggcacagcggccctgggctgcctggtcaaggactacttcctatatactgtctgagcgggctggcaaggcgcatag

SEQ ID NO: 792344 - DNA, 642 bp, Homo sapiens
  misc_feature: 49825.44.86.H09.1.pb.heavy.1.raw 49825
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctccagatgggtcctgtcccaggtgcagctgcaggagtcggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcagagtcgtctcaccatttcgagggacacgtccatgaaccgctctccctgaaactgacctcgtgaccgcgcggacacggcgcgtttatttctgtgcgaggcgagactggtctttcaatctatggggccgtggcaccctggtcactgtccctcagcttccacaagggccatcggtcttcccctggcgcctgctccaggagcacctctgggggcagcgggcgccctgggctgcctggtcaaggactacttcctatatactgttagcgggctggcaggcgcatag

SEQ ID NO: 792345 - DNA, 692 bp, Homo sapiens
  misc_feature: 49880.44.36.D03.1.pb.heavy.1.raw 49880
ctatgcgccttgccagcccgctcagacagtatataggaagtagtccttgaccaggcagcccagggccgctgtgctctcggaggtgctcctggagcagggcgcaggggaagaccgatgggcccttggtgaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcgcgtactctgtgataaagctggcaactttgttttactgcggccaagccactccagccccttccctggagcctggcggacccagtccatatagtggtcactgatggtgaatccagaggcgacacaggagagtctcaggaccctccaggctggaccaagtctccccggactcaccaactgcacttcactctgacaccttgtaaaataacaacaaggaaaacccagctcagcccgaactccatggtgatcctctgtgttcagtgctgatcaccaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 792346 - DNA, 595 bp, Homo sapiens
  misc_feature: 49919.UNK.UNK.UNK.pb.heavy.1.raw 49919
ctatgcgccttgccagcccgctcagacagtatataggaagtagtccttgaccaggcagccagggccgctgtgccccagaggtgctcctggagcagggcgccaggggaagaccgatggcccttgtggaagctgaggtgacaatgaccaggttcctgcccagatccaaggctcatgcgagctgggtacggacctccgcacagtagtaacgccgtgtcgtcggatttcaaagaactcatgtcatggagactgtgtctggactgtcgcgtaatcgtaattctgccccgaatccgtgctaggtgagtgagcaaaaaaggatgatccccatcaccaagcccttgtcaggggcctgcgccccgtatggtataagttgaactggagtacttccagaccgtgcaggaaaggtcaccgaggaccaggttgcggcatctagtcccagctgcaccagttgaccagggactggacactgtgctgccacccaaagaggaactccatccatccatggtgatgagctgtgctccaggggcttcgaggaggaagtggttgtcgtagatctaaatcagcaccgtcgtgtattacgctgatgcgcgagaggacg

SEQ ID NO: 792347 - DNA, 582 bp, Homo sapiens
  misc_feature: 49957.44.78.H01.1.pb.heavy.1.raw 49957
cgtatcgcctccctcgcgccatcagacagtatatacacgaccggtgctcgatttagtgtgagtagtttgggtttgggggaagaggaagactgacggtcccactcccaggtacagctggtgcagtctgggctgaggtgaagaagcctggggcctcagtgacagtctcctgcacggcttctggatacacgttcatcaattatgatattaactggtgcgacaggccgctggacaagggctggagtggatgggatggatgaagccctatagtggcaacacgggctttgcccagaagttccaaggcagagttagtatgaccaggagcaacctcccaggtacagtctacatggaactgagcagcctgagatctgagacacggccgtgtatttctgtgcgagagcaccagcacctggcttgacttgtgggccagggaaccctggtcaccgtctcctcagcctccaccaaggccatcggtcttcccctggcgccctgctccaggagcacctccgagagcacagcggccctgggctgcctggtcaagactacttcctatatactgtctgagcgggctggcaaggcgcatag

SEQ ID NO: 792348 - DNA, 593 bp, Homo sapiens
  misc_feature: 49966.UNK.UNK.UNK.pb.heavy.1.raw 49966
gggcggtttgatccggtgaagccagatagttaatcagatcgttgtatacgctatcgtaaatagtgcgtccgtcggcaggtgtgctcaaatgcatccagaccttcgtgataccagcgcacagcacgactgagcggttttctccagataaggcacatgatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttgcgcagactcacagcactttctgagagcgatggctggtcaggtagcccatcagccactcaacgcgcggatcgaagttccaccaggtggcgttatcaccttcaaattcctgataaatacgctccggtagagcatatcgcgagcacccc

SEQ ID NO: 792349 - DNA, 700 bp, Homo sapiens
  misc_feature: 49983.44.55.E11.1.pb.heavy.1.raw 49983
ctatgcgccttgccagcccgctcagacagtatataggaagtagtccttgaccaggcagcccagggccgctgtgccccagaggtgctcttggaggagggtgccagggggaagaccgatggcccttggtggaggcggaggcgacggtgaccagggttccctggccccagaagtcaaacgaataataacactccgagcgccgacttgtctcgcacagtaatagacgccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggaccccccaggctgactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgataca

SEQ ID NO: 792350 - DNA, 698 bp, Homo sapiens
  misc_feature: 49988.44.27.C05.1.pb.heavy.1.raw 49988
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttcctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttctccatgaaatgacacacctgccacccactccagccctcgcctggagcctggcggacccactgcatattccaattatcgaaggtgaatccagaggctgcacaggagagtctcaggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccagcgacttccagtgctggctcgtctcccaggccccaaacccttcgatcgcgtctaaatcgagcaccggtcgtgtatatactgtctgatgcgcgagggaggcgatacg

SEQ ID NO: 792351 - DNA, 676 bp, Homo sapiens
  misc_feature: 49993.UNK.UNK.UNK.pb.heavy.1.raw 49993
cgtatcgcctccctccgcgccatcagtctatactatcacgaacggtgctcgatttagtgagtcagtaagggaaagggggcgggagaggagccccagcactagaagtcggcggtgtttccattcggtgatcagcactgaacacagaggactcaccatggagtttgggctgagctgggttttcctcgttgctcttttaagagtgtccagtgtcaggttcagctgtgagtctgggggaggcgtgtccagcctgggacgtcctgagactctcctgtgttgcgtccggactcagttttcagtgactctgccatgcactggtccgccaggctccaggcaaggggctggagtgggtggcagtcatctgtctgatggaagtaaagaatactatggaaactccgtgaagggccgattctccgtctccagagacaattccaagaacaccgtgtatctacaaatgaacaatttgagagccgagactcggctctctattattgtacgagcccatcgttctactggggccagggagcccctggtcaccgtctcctcagcctccaccaagggcccatcggtcttcccctggcgccctgctccaggagcacctccgagagcacagcggccctgggctgcctggtcaaggactacttctatatactgtctgagcgggctgcaaggcgcatag

SEQ ID NO: 792352 - DNA, 700 bp, Homo sapiens
  misc_feature: 49997.44.27.C05.1.pb.heavy.1.raw 49997
ctatgcgccttgccagcccgctcagacagtatataggaagtagtccttgaccaggcagccagggccgctgtgctctcggaaggtgctcctggagcagggcgccagggggaagaccgatgggcccttggtggaggccgagggagacggtgaccagggttccctggccccaggcgtcgaatgaaccgattttggaaacagatagtctcgcacaaaatacacggccgtgtcctgaggtctcaggctgttcatttgaagagacactgtgttctcggaattgtctctggagatggtgaaatcggccctcaacggaatcaccgtagacttgatttcctccatgaatgacacactgccacccactccagcccctcgcctggagcctggcggacccactgcatattccaattatcgaaggtgaatccagaggctgcacaggagagtctcagggaccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaatcgagcaccggtcgtgtatatactgtctgatggcgcgagggaggcgatacg

SEQ ID NO: 792353 - DNA, 707 bp, Homo sapiens
  misc_feature: 50007.44.62.F07.1.pb.heavy.1.raw 50007
ctatgcgccttgccagcccgctcagacagtatataggaaagtagtccttgaccaggcagcccagggccgctgtgctctcggaggtgctcctggagcagggcgccaggggaagaccgatgggccttggtggaggctgaagagacggtcaccactgtccccggccccaaatactaaaggtgtcatggggggtcaccgtggtcctggctttcaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccccagactccaacaactgcacttcacacaacgacaccctttaaaaagccacaagaaaaggcagctcagcccaaactccatggagacttctctctgttcggtcctggtcacaaatgaagacacctgaaaatccccagggctgggctcctctctcagagctcccctttccctttatgcgactactaaatcgagcaccggtcgtgatatactgtctgatggcgcgagggaggcgatacg

SEQ ID NO: 792354 - DNA, 616 bp, Homo sapiens
  misc_feature: 50016.44.27.C05.1.pb.heavy.1.raw 50016
ctatgcgccttgccagcccgctcagacagtatataggaagtagtccttgaccaggcagcccagggccgctgtgctctcgaggtgctcctggagcagggcgccagggggaagaccgatgggccccttggtgaggccgaggagacggtgaccagggttccctggccccaggcgtcggaatgaaccgattttggaaacagatagtctcgcacaaaaatacacggccgtgtcctgaggtctcagggctgttcatttgaagagacactgtgttctcggaattgtctctggagatggtgatcggccctcaacggaatcaccgtagactgatttcctccatgaaatgacacacctgccacccactccagcccctcgcctggagcctggcggacccactgcatattccaattatcgaaggtgaatcccagaggctgcacaggagagtctcagggacccccctactggggcgcacgcctccccagactccacgattgcacctgacacatgacacctcttaagagggcaacgaggaaaacccagctcagcccaaacccttcgatcgcgtctaaatcgagcaccggtcgtggtatatactgtctgatggcgcgagggaggcgatacg

SEQ ID NO: 792355 - DNA, 697 bp, Homo sapiens
  misc_feature: 50028.UNK.UNK.UNK.pb.heavy.1.raw 50028
ctatgcgccttgccagcccgctcagacagttatataggaagtagtccttgaccaggcagcccagggccgctgtgctctcggaggtgcttcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacaccggtgttcttggaattgtctctggagacggagaatcggcccttcacggagtttccatagtattctttacttccatccagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgcctgatcaccgaatggaaacaccgccgacttctagtgctgggctcctctcccagcccccctttcccttactgactcaaaactataatccgagcacacggtcgtgtatatactgtctgatggccgcgagggaggcgatacg

SEQ ID NO: 792356 - DNA, 725 bp, Homo sapiens
  misc_feature: 50042.UNK.UNK.UNK.pb.heavy.1.raw 50042
gtatcgcctccctcggcgccatcagggacagtatatacacgacccgtgctcgatttagcacctcgcacgttgggtttggggcggagaggagcccagcactgggattcgagtgtttccattcggtgatcagcactgaacacagaggactcaccatggagttttggctgagctgggttctccttgttggacttttaaaaggtgtccagtgtgaggtgcggctgatggagtctggagggaggcttagtccagcgctgggggggggtccagagactctcctgtgcagcctctggggctcaccgtcagcagcaaactacatgagttgggtccgccaggctccagggaagggctggagtggggtctcagtcatttatactggtgatttcacatactacgcagactccgtgaaggggccgattcaccatctccagggacaattccaggaaccacgggtttatcttcaaatgaacaacctgagaaggcgacgacaacggccgtctacttactgtgcgagacaagtcggcgctcggagtggttattattcgtttgacttctggggccagggaaccctggtcacccgggtcgcctcgcctccaccaagggcccatcggtctgcccctggcaccctcctccaagagcacctctggggggcacagcggccctgggctgcctggtcaaggactactttcctatatactgtctgagcggggctggcaaggcgcgcatag

SEQ ID NO: 792357 - DNA, 729 bp, Homo sapiens
  misc_feature: 50103.44.33.C11.1.pb.heavy.1.raw 50103
cgtatcgcctccctcgcgcatcagacagtatatacacgaccggtgctcgatttagagtgagctcgttggggtttggggagctctgggagaggagcccagcaccagaagtcggcggtgtttccagtcggtgatcagcaccgaacacagaggactcaccatggagtttgggctgacctgggttttctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgttgaagggccgattcaccatctccagagacaattcgaagaacacactatatctggaaatgaatagcctgagagccgaggacacggctgtctactactgtgcgagagatgggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggcctggggctgcctggtcaaggactacttctatatactgtctggcgggctggcaaggcgcatag

SEQ ID NO: 792358 - DNA, 661 bp, Homo sapiens
  misc_feature: 50112.UNK.UNK.UNK.pb.heavy.1.raw 50112
ctatgcgccttgccagcccgctcagacagtatataggaagtagtccttgaccaggcagccagggccgctgtgctctcggaggtgctcctggagcagggcgccaggggaagcgatggccctggtgaggctgaggagacggtgaccaggttccctggccgaatgaaaccatccagacagtaatagacggctgtgtcctcggtgttcaggctgttcatctgcagagacaccgtatcttttgaatcatctcttgagatggtgaatctgcctttcacggtgcagcgtagtctgctgtcccaccgtcagctttggttctaatacggccaacccactccagccccttccctggagcctggcgacccaggtcatccaggcgttactgaaagtgaatccagaggctgcacaggagagtctaagggactccccaggctttaccaaacctccagactccaccaactgcactcacactggacacctttaaatagcagcaggaaaatccagctcagcccaaactccatggtgagtcctctgtgttcagtcctgatcacctgaatgaaaacacctggaatccaaggctgggctcctctcccagagctcaacacacctctctctaaatcgagcaccggtcgtgtatatactgtctgatgcgcgaggaggcgatacg

SEQ ID NO: 792359 - DNA, 727 bp, Homo sapiens
  misc_feature: 50132.44.39.D06.1.pb.heavy.1.raw 50132
cgtatcgcctccctcgcgccatcagacagtatatacacgaccggtgctcgatttagtgacatctcgcagttctttgggggagagacgagcccagcactggaagtcgcccggtgtttccattcggtgatcatcactgaacacagaggactcaccatggagtttgggctgagctgggtttttcctcgttgctcttttaagaggtgtccagtgtcaggaagcacttggtggagtctgggggaggcgtggtccagcccgggaggtccctgagactctcctgtgtagcctctgggttctcattcgatagatttggtttgcactgggtccgccaggctccaggcaaggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 792360 - DNA, 608 bp, Homo sapiens
  misc_feature: 50196.44.23.C01.1.pb.heavy.1.raw 50196
gtatcgcctcctcgcgccatcagacagtatatacacgaccggtgctcgatttagtacacgtgattagggattggggcagggtgaacacctgtggtttttcctcctgctggtggcagctccccagatgggtcctgtcccaggtgcagctgcaggagtcgggcccaggactgtgaggcctcgggaaccctgtctctcatctggactgtctctggagtttccatcagtttctgatcattcttggggctggatccgcagccccagggaggggaatggagtggattggtgacatccattatactgggggcgacgtactactctccgtccctcaagagtcgtctcaccatttcgaggacacgtccatgaaccgctctcctgaaaactgacctccgtgaccgccgcggacacgccgtttatttctgtgcgaggcgagactggtctttcaatctatggggccgtggcaccctggtcactgtctcctcagcttccaccaagggcccatcggtcttcccctggcgccctgctccagagcacctctggggcacgcggcctgggctgcctggtcaaggactacttcctatatactgtctgcgggctggcaaggcgcatag

SEQ ID NO: 792361 - DNA, 649 bp, Homo sapiens
  misc_feature: 50288.44.29.C07.1.pb.heavy.1.raw 50288
ctatgcgccttgccagccgctcagacagtatataggaagtagtccttgaccaggcagcccaggccgctgtgctctcggaggtgctcctggagcaggcgccaggggaagaccgatgggcccttggtggaggctgaagagacggtgaccattgtcccttggccccagatatcaaagccactcacataaccaccacttttataatagttgatcatgtgtgcgcagtagtattggctgtgtccgcaggggccatgttggccactctaaggatcacctgcgtattggaggcgtctccggtgatggagagtctgctcttcagagatgactgtagcgccttcatcatccaataaatgagtgcaagccactccagggcctttcctgggggctgacggacccagccacaatcgctccatcactcctgagtgagaaccagagaggttgcaggtcagcgtgagcggtctgtgtggcttcaccagcgtaggaccagactccttcaaggtatctggacaagacccatgaagggatggtcagcagcaggagcgtggagcaaagtgtgtccatggtgggcacaggagtcccctttcccttcgtagcactctaaatcgagcaccggtcgtgtatatactgtctgatgcgcgagggaggcgatacg

SEQ ID NO: 792362 - DNA, 697 bp, Homo sapiens
  misc_feature: 50299.UNK.UNK.UNK.pb.heavy.1.raw 50299
ctatgcgccttgccagcccgctcagacagtatataggaagtagtccttgaccaggcagcccagggccgctgtgctctcggaggtgctcctgggcagggcgccagggggagagaccgatgggcccttggtggaggctgaggagacggtgacccagggttccctggcccccagtggacagttcctgatataaacacaacacaataataacatgcccgtgttcctcgggtttcaggttagtcattcgcagaatcaatgagttcttgaagtcatctcttgagaggggtgaatctggctttcacagacgcggcgtactctgtgataaagctggcaacttttgtttttactgcggccaagccactccagcccttcctggagcctggcggacccagtccatatagtggtcactgatggtgaatccagaggcgacacagggaagtctcaggacccttccaggctggaccaagtcccccggatccacaacgcacttcactctggacacctttgtaaaataacaacaaggaaacccagctcagcccgaactccatggtgaagtcctctgtgttcagtgcgatcaccaaatgaaacacctgggaatctggggctgggctcgctctcagagctcccaagagagatcgtgacgcagctaaacgagcaccgtcgtgtatatactgtctgatggcgcgaggaggcgattacg

SEQ ID NO: 792363 - DNA, 702 bp, Homo sapiens
  misc_feature: 50310.44.62.F07.1.pb.heavy.1.raw 50310
ctatgcgccttgccagcccgctcagacagtatataggaagtagtccttgaccaggcagcccagggccgctgtgctctcggaggtgctcctggagcagggcgccaggggaagacgatgggcccttggtggaggctgaagagacggtcaccactgtcccccgccccagtactaaaggtgtcatggggggtcaccgtggtcctggctttcaaacagtaatagacgcctgtgtcctcggtctcaggttttcatttggagaaacaatttgtcctgcgaattgtccctggaaatggtgaagcggcccttcacggagtctccgtagaaagtgacaccaccagctccgatacttgagacccactccagtccctccctggagcccggcggacccaggtcatgccataggcactaaaggtgaatccagaggccgcacaggagagggtcagggacctcccaggccgaatcaggccccccccagactccaacaactgcacttcacacacgacaccctttaaaaaagccacaagaaaaaggcagctcagcccaaactccatggagacttctctctgttcggtcctggtcaccaaatgaagacacctgaaaatccaggctgggctcctctctcagagctcccctttccctttatgcgactactaaatcgagcaccggtcgtgtatatactgtctgatggcgcgaggaggcgatacg

SEQ ID NO: 792364 - DNA, 685 bp, Homo sapiens
  misc_feature: 50321.44.74.G08.1.pb.heavy.1.raw 50321
cgtatcgcctccctcgcgccatcagaccagtatatacacgaccggtgctcgattagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggccctggacaagggcttgagtggatggtggaatcatccctctttttggctcactcacctacgcacgagacttcggggcagaattacgattaccgcggacaagtccacagacacagtctccatgacaatgagttctttgaaatccgacgacacggccgtctactactgtgcgagaggtccgtaccccagctcgcatggagcctttgagatctggggcaggaaccctggtcattgtcacctcagcttcccaagggcccatcggtcttccccctggcgcctgctccaggagcacctctgggggcacagcggccctgggctgcctggtcaaggactacttcctatatactgtctgagcgggctggcaaggcgcatag

SEQ ID NO: 792365 - DNA, 627 bp, Homo sapiens
  misc_feature: 50325.UNK.UNK.UNK.pb.heavy.1.raw 50325
cagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggagtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaagcctcaccagtcctgggcccgactcctgcagctgcacctgggacaggacccatctgggagctgccaccagcaggaggaaaaaccacaggtgctcatgttcttgcacaggaggtccttgactctcagaaagcatcccaaaacccaagtctatagcactaaatcgagcaccggtcgtttatactgtctgatggcgcgagggaggcgatacg

SEQ ID NO: 792366 - DNA, 727 bp, Homo sapiens
  misc_feature: 50326.44.33.C11.1.pb.heavy.1.raw 50326
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcgctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctccagagctccccaaacccaacgagctcactctaaatcgagcaccggtcgtgtatatactgtctgatggcgcgagggaggcgatacg

SEQ ID NO: 792367 - DNA, 712 bp, Homo sapiens
  misc_feature: 50335.UNK.UNK.UNK.pb.heavy.1.raw 50335
ctatgcgccttgccagcccgctcagacagtatataggaagtagtccttgaccaggcagcccagggccgctgtgcccccagaggtgctcttggaggagggtgccagggggaagaccgatgggcccttggtggaggcggagggcgacggtgaccagggtttccctggccccagaagtcaacgaataataaccacttccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccccagaggctgcacaggagagtctctgggaccccccaggctggactaagcctcctccagactccatcagcccgcacctcacactggacacctttaaaagtccaacaaggagaacccagctcagccaaaactccatggtgagtctctgtgttcagtgctgatcaccgaatggaaacacctcggaaatcccagtgctgggctcctctccccccccaaacccaatatgtatactctaaatcgagcacggcggtcgtgtatatactgtctgatggcgcgagggaggcgatacg

SEQ ID NO: 792368 - DNA, 689 bp, Homo sapiens
  misc_feature: 50392.44.23.C01.1.pb.heavy.1.raw 50392
cgtatcgcctccctcccaagcgccatcagacagtatatacacgaccggtgctcgatttagtacacgtgattagggattggggatgctttctgagagtcaaggacctcctgtgcaagaacatgaagcacctgtggttttttcctccctgctggtggcagctccccagatgggtcctgtcccaggtgcagctgccaggagtcgggcccaggactggtggaggccttcgggaaccctgtctctcatctgcactgtctctggagtttccatcagttctgatcattctttgggctggatccggcagcccccaggggaggggaatggagtggattggtgacatccattatactggggcgacgtactactctcgtccgctccctcaaagagtgccgtctcaccatttcgagggacacgtccatgaaccgcttctcccctgaaactgacctccgtgaccgccggcggacacggccgtttatttctgtgcgagggcgagactggtctttcaatctatgggggccgcgtggcaccctggtcactggtctcctccagccttccaccaagggcccatcgccgggtcttccccctggcgccctgctcaggagcacctctgggggcaacagcggccctgggctgcctgcgtcaaggactaccttcctatgatactgtctgagcgggcctggcaaggcgcatag

SEQ ID NO: 792369 - DNA, 616 bp, Homo sapiens
  misc_feature: 50413.UNK.UNK.UNK.pb.heavy.1.raw 50413
cccgaccacgcttgctagggacttggagctaaggacgacatattgcctttagacagtcgaaggtgacgccttggctaccactgaacgtttaggcggcccagatgcggtctggggatgacctaactcgcagcttatcgatgatctactggcacgctcaaccaaccaggtcttgatgcgcgcgataggactgacgggatcgctacagacatttactcgctagtaacttaattgagatcctaggggatgggataggaaatagaatccacccctatccaccccccacatgcctgctttgggtgttgagtttacttttatttcggtgttggaatgagttgaacttccgggaagtggagtatgggtttgtctacttcccctaaccgcaaagtactagttttacgagtggcgttggcacgagccaagccagtcacaggttaataaacaattcaacgtgggcgtaaagattggccgcttgctgtgggcattgcaagctgggttttgcagcatttggcatgcagacgacatatgaatctgcgggacccctagtgggccaagatggccgctagcgggttccgcagcttttgacctggaccaggggtgcatagcctgcccagccttc

SEQ ID NO: 792370 - DNA, 702 bp, Homo sapiens
  misc_feature: 50442.44.36.D03.1.pb.heavy.1.raw 50442
cgtatcgcctccctcgcgccattcagaccagtatatacacgaccggtgctcgattagctgcgtcacgatctctcttggggagctctgagagccgagccccagccccagaattcccaggtgttttcatttggtgatcagcactgaacacagaggactcaccatggagttcgggctgagctgggttttccttgttgttattttacaaggtgtccagagtgaagtgcagtggtggagtccgggggagacttggtccagcctggagggttcctgagactctcctgtgtcgcctctggattcaccatcagtgaccactatatggactgggtccgccaggctccagggaaggggctgagtggctggccgcagtaaaaacaaagtgccagcttatcacagagtacgccgcgtctgtgaaagccagattcaccctctcaagagatgacttcaagactcattgattctgcgaatgactaacctgaaaccgcgagacacgggcatgtattattgtgttgtgttttatatcaggaactgtccactgggccaggaaccctggtcacccgtctcctcagcctccaccaaggggcccatcggtcttccccctggcgccctgctccaggagcacctccgagagcacagcggccctgggctgcctgggtcaaggactacttcctatatactgtctgagcgggctggcaaggcgcatag

SEQ ID NO: 792371 - DNA, 685 bp, Homo sapiens
  misc_feature: 50450.UNK.UNK.UNK.pb.heavy.1.raw 50450
cgtatcgccttcctcgcgccatcagacagtatatacacgacggtgctcgatttagctgcgtcacgatctctcttgggagctctgagagcggagcccagccccagaattcccaggtggttttcatttggtgatcagcactgaaccagaggactcaccatggagttcggctgagctgggttttccttgttgttatttacaggtccagagtgaagtgcagttggtggagtcggggagacttggtccagcctggagggtccctgagactctcctgtgtcgcctctggattcaccatcagtgaccactatatggactgggtccgccaggctccagggaaggggctggagtggcttggccgcagtaaaaacaaagtgccagcttatcacagagtacgcgcgtctgtgaagccagattcaccctctcagaagatgacttcaagaactcattgattctgcgaatgactaacctgaaaccgaggacacgggcatgtattatgtgttggttttatatcaggaactgtccactggggccagggaaccctggtcaccgtcctcagccttccccaagggcccatcgatcttcccctggcgccctgctccaggagcacctcgagagcacagcggcccttggctgcctggtcaaggactacttcctatatactgtctgagcgggctggcaaggcgcatag

SEQ ID NO: 792372 - DNA, 673 bp, Homo sapiens
  misc_feature: 50495.UNK.UNK.UNK.pb.heavy.1.raw 50495
cgtatcgcctccctcgcgccatcagagttataccgaccggtgctcgatttagccgtccacgatctcctctggggaagagcggagccccccccagaattcgccaggtgtttctttggtgatcagcactgaacacagaggactcaccatggagttgggctgagctgggttttcctgttgttatttaaaggtgtcagtgtagtgcagttggtggagtccggggagactggtccacctggaggggtccctgagactctcctgtgcgctctggattcaccatcagtaggacatatgactgggtccgccggctccaggaagggcctggagggcttggccgcagtaaaaaaaagttgccagctttatcacagagtacgccgcgtctgtgaaagccagattcccctctcaacagatgacttcaaagaaccattgttctgcgaatgactaactgaaaaccgaggacacggcatgtattttttgctgtctgtgtttaaaatcggactgtccactggggccagggaaccctggtcaccgtctcctcagcctcccccaaggggccatcggtcttccccctggcgccctgctccaggagcacctccgagcaccgcggcctgggctgcctggtcaaggactactttcctatatactgtctctgagcgggcctggcaaggcgccatag

SEQ ID NO: 792373 - DNA, 696 bp, Homo sapiens
  misc_feature: 50498.44.36.D03.1.pb.heavy.1.raw 50498
ctatgcgccttgccagcccgctcagacagtatataggaagtagtccttgaccaggcagccaggccgctgtgctctcggaggtgctcctggagcagggcgccagggaagacgatgggccctggtggaggctgaggagacggtgaccagggttcccggccccagtagtcaaaaccagccactgaccaagtggcccgatctctcgaacagaagtagacagccgtgtcctcgtctctcaggctgttcatttccagatacagtgagttcttgcattgtccctggaattggtgaatcggcccttcacagagtctgcgtagtaggtggtatctccagcatattaacatatgaaacccactccagccccttccctggagcctggcggacccagttcatggcatagtcactgaagatgaatccagaggctgcacaggagagtctcagggacccccccccgctgtaccaagcctccccagactccaccagccgcacctcacagtgacaccttctaaatagcaacaggaaaaccagcgcagccccaactccatggtgagtcctctgtgttcagtgctgatcaccaagtggaaatgccttgaatccagggctaaggcacctctctgagagctccaagagagatcgtgacgcagctaaatcgagcaccggtcgtgtatatactgtctgatggcgcgaggaggcgatacg

SEQ ID NO: 792374 - DNA, 699 bp, Homo sapiens
  misc_feature: 50521.UNK.UNK.UNK.pb.heavy.1.raw 50521
ctatgcgccttgccagccgctcagacagtatataggaagtagtccttgaccaggcagccagggccgctgtgccccagaggtgctcctggagcaggggcgccagggggaagaccgatggcccttggtggaagctgaagagacggtgaccattgtccctggccccaaatatcaaatgcatcgacgtcccaggatcgcctggcgcagtaatagacgcctgtgtcgtcggtctcaggttgctcatttgtaaatggccaacactgttggagtcatcccttgagacggtgaatcttcccttcacagacgcggcgtactctttacttccaccataacgtttcattctgacgaaagtgatccactcaagcccttccctggagcctgacggacccaggccaagtgataatcactaagactgaatcctgagactacacaggagagtctcagagaccgccctggctgtgccaagccccccccgactccgccagtcgccctcgcactggacaccttctaaaaaactacaaggaaaatcaagattagcccaaactccatggttgtggtctgtgctcagtgctgatcaccagtggaaactcctgggaatctcacggctggggctcctctccagagctcccctttgtgtgttcagacgtctgctaatcgagcacgtcgtgatagtatagactgatggcgcggggaggcgatacg

SEQ ID NO: 792375 - DNA, 645 bp, Homo sapiens
  misc_feature: 50582.UNK.UNK.UNK.pb.heavy.1.raw 50582
ctatgcgccttgccagcccgctcagacagtatataggaagtagtccttgaccagggcccagcccagggccgctgtgccccagaggtgctctggagcagggcgccaggggaagaccgatgggcccttggtggaagctgaggagacagtgaccagggtgccacggccccataattgaaagaccagtctcgcctcgcacagaaataaacggccgttccgcggcggtcacggaggtcagtttcagggagaagcggttcatgacgtgtccctcgaaaatggtgagacgactctgagggacggagagtagtacgtcgccccagtataatgatgtcaccaatccactccattccctcccttggggctgccgatccagcccaagaatgatcagactgatggaaactccagagagcagtgcagatgagagcaggggttcccgaaggcctcacagtctggcccgactcctgcagctgcacctgggacaggacccatctgggagctgccaccagcaggaggaaaaaccacaggtgcttcatgttcttgcacaggaggtccttgactctcagaaagcatcccaaaacccaagtctatgcactaaatcggagcaccggtcgtgtatatactgtctgatggcgcgagggaggcgatacg

SEQ ID NO: 792376 - DNA, 691 bp, Homo sapiens
  misc_feature: 50604.UNK.UNK.UNK.pb.heavy.1.raw 50604
ctatgcgccttgccagccgctcagacagtatataggaagtagtccttgaccaggcagccagggccgctgtgctctcggagggtgctcctggagcagggcgccaggggaagaccgatgggcccttgtgaggccgaggagacggtgaccagggttccctggcccaggcgtcgaatgaaccgattttggaaacagatagtctcgcacaaaaatacacggcggtgtcctgaggtctcaggctgttcatttgaagagacactgtgttctcggaattgtctctggagatggtgaatcggccctcaacggaatcaccgtagacttgatttcctccatgaaatgacacacctgccaccactccagcccctcgcctggagcctggcggacccactgcatattccaattatcgaagtgaatccagaggctgcacaggagagtctcagggacccctactggggccacgcctcccccagactccacgaattgcacctgacacatgacacctcttaagagggcaacgaggaaaacccagctcagcccaaacccatggtgagtcctctgtgttcagtgatgatcaccgagtggaaacaccgcgacttccagtgctggctcgtccccaggccccaaacccttcgatcgcgtctaaatcgagcaccgtcgtgtatatactgtctgatggcgcgagggaggcgatacg

SEQ ID NO: 792377 - DNA, 723 bp, Homo sapiens
  misc_feature: 50622.44.85.H08.1.pb.heavy.1.raw 50622
ctatgcgccttgtcagcccgctcagacagtatataggaagtagtccttgaccaggcagcccagggccgctgtgcccccagaggtgctcttggaggagggtgccaggggaagaccgatgggccccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgtcatttgcagatacagcgtgttcttggaattgtctctggagatggtgaatcggcccttcacggagtctgcatagtattattacttccatcataccatataagtgccacccactccagccccttgcctggagcctggcggacccagtgcatgccataggtactgaaggtgaatccaggacgctgcacaggagagtctcagggacctcccaggctggaccacgcctcccccagactccaccagctgcacctgacactggacacctcttaaaagagcaacgaggaaaaacccagctcagcccaaactccatggtgagtcctctgtgttcagtgctgatcaccgaatggaaacaccgccgacttctagtgctgggccctctcccagagctccccgcgactgagtgatactaaatcgagcaccggtcgtgtatatactgtctgatggcgcgagggaggcgaatacg

SEQ ID NO: 792378 - DNA, 703 bp, Homo sapiens
  misc_feature: 50636.44.55.E11.1.pb.heavy.1.raw 50636
ctatgcgccttgccagcccgtcagacagtatagtaggaagtagtcttgaccaggcagcccagggccgctgtgccccagaggtgctcttggaggaggggtgccaggggaagaccgatggccttggtggaggcggaggcgacgtgaccagggttccctggcccagaagtcaaacgaataataaccactccgagcgccgacttgtctcgcacagtaatagacggcgccgtgtcgtcgcctctcaggttgttcatttgaagataaaccgtgttcctggaattgtccctggagatggtgacatcggcccttcacggagtctgcgtagtatgtgaaatcaccagtataaaatgactgagacccactccagccccttccctggagcctggcggacccaactcatgtagttgctgctgacggtgagccagaggctgcacaggagagtctctggacccccaggctggactaagcctcctccagactccatcagccgcaccttcacactggacaccttttaaaagtccaacaaggagaacccagctcagccaaaactccatggtgagtcctctgtgttcaggtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792379 - DNA, 701 bp, Homo sapiens
  misc_feature: 50641.44.73.G07.1.pb.heavy.1.raw 50641
cgtatcgcctccctcgcggccatcagacagtatatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacaacactgcatctgcaatgtacaacctcacaagtgaggacacggctgttctattattgtgcgaggagccccctcgagacggtccccgcttggactactggggcccagggaaccctggtcaccgtctcctcagcctccacaagggcccatcggtcttccccctggcgccctgctccaggagcacctccgagagcacagcggccctgggctgcctggtcaaggactacttcctatatactgtctgagcggcgctggcaagggcgcatag

SEQ ID NO: 792380 - DNA, 607 bp, Homo sapiens
  misc_feature: 50650.UNK.UNK.UNK.pb.heavy.1.raw 50650
gaaggctgggcaggctatgcaccctggtccaggtcaaaagctgcggaacccgctagcggccatcttggccactaggggtcccgcagattcatattgtcgtctagcatgcacaatgctgcaaacccagctgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792381 - DNA, 716 bp, Homo sapiens
  misc_feature: 50666.UNK.UNK.UNK.pb.heavy.1.raw 50666
ctatgcgccttgccagcccgctcagacagtatatagggagtagttccttgaccaggcaggcccagggccgctgtgccccagaggtgctcttggaggagggtgccagggggaagaccgatgggcccttggtggaggcggaggcgaccgggtgaccagggttccctggccccagaagtcaaacgaataataaccactccgagcgccggacttgtctcgcacagtaatagacggccgtgtcggtcggcctctcaggttgttcatttgaagataaaccgtggttcctggaattgtccctggagatggtgaatcggcccttcacggagtctgcgtagtatgtgaaatcaccagtataaatgactgagacccactccagccccttccctggagcctggcggacccaaactcatgtagttgctgctgacggtgagcccagaggctgcacaggagagtctctggagccccccaggctgactaagcctcctccagactccatcagccgcacctcacactggacacccttttaaaagtccaacaaggagaacccaggctcagccaaaactcccatggtgagtcctctgtgttcagtgctgatcaccgaatggaaacacctcggaatcccagtgctgggctcctctccccaaacccaacgtggcgagtgctaaatcgaagcaccggtcgtgtatatactgtctgatggcgcgaggggaggcgatacg

SEQ ID NO: 792382 - DNA, 660 bp, Homo sapiens
  misc_feature: 50671.44.53.E09.1.pb.heavy.1.raw 50671
ctatgcgccttgccagcccgctcagacagtatataggaagtagtcccttgaccaggcagcccagggccgctgtgctctcggaggtgctcctggagcagggcgccagggggaagaccgatgggcccttggtggaggctgaggatgaggagacggtgaccgtggtcccttggccccagacgtcccaagcgtagtagaattgagacgacctgccataggcggaccatgtctgacacagtagtagacagccgtgtcggccggcggccacagaactcactttcagggaaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggccccgactcccgcagctgcggctgagacaggacccatctgggagccgccaccagcaggaggaagaaccacaggtggcttccccccaaacccaacacactctctctaaatcgagcaccggtcgtgtatatactgtctgatggcgcgagggaggcgatacg

SEQ ID NO: 792383 - DNA, 656 bp, Homo sapiens
  misc_feature: 50691.UNK.UNK.UNK.pb.heavy.1.raw 50691
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcaacaggaggtccttgactctcagaaagcatccccaaaacccaagtctatagcactaaatcgagcaccggtctgtatatactgttctgatggcgccgagggggcgatacg

SEQ ID NO: 792384 - DNA, 728 bp, Homo sapiens
  misc_feature: 50702.UNK.UNK.UNK.pb.heavy.1.raw 50702
ctatgcgccttgccagcccgcgctcagacaggtatataggaagtagtccttgaccagggcagcccagggccggctgtgcccccagaggtgctccctggagcagggcgccagggggaagaccgatgggcccttggtggaagcctgaagagaacggtggaccattgtcccctggccccaaatatcaaatgcatcgacgtccaggatcgcctggcgcagtaatagaacgcctgtgtcgtcgggtctcaggttgctcatttgtaaatggccaacactgttggagtcatcccttgagacggtgaatcttcccttcacagacgggcggcgtactctttacttccaccataaaacgtttcattctgacgaaagtgatccactcaagccccttccctggagcctgacggacccaggccaaagtgataatcactaagactgaatcctgagactacacaggagagtctcagagaccgccctggctgtgccaagcccccccccgactccgccagtcgcccctcgcactggacaccttctaaaaaaaactacaaggaaaatcaagattagcccaaactccatggttggtggtctgtgctcagtgctgatcaccaagtggaaactcctgggaatctccacggctgggcttcctctcccagagctcccctttgtgtgttcagacgtctgctaaatcgaccggtcgtgtatatactgtctgatggcgcgagggaggcgatacg

SEQ ID NO: 792385 - DNA, 710 bp, Homo sapiens
  misc_feature: 50752.UNK.UNK.UNK.pb.heavy.1.raw 50752
ctatgcgccttgccagcccgctcagacagtatataggaagtagtccttgaccaggcagcccagggccgctgtgccccagagtgctcttggaggagggtgccagggggagaccgatggccctggtggaggctgaggagacggtgaccgtggtccctggcccccagacgtccataccgtagtagtagtcccagcaggtggtagtactacaatatgtcctcgcacagtaatacacagccgtgtcctcggctctcaggcgttcattgcagatacagcgtgttcttggattgtctctggagatggtgaatcgcccttcacggagtctgcatagatttattactccatcataccatataagtgccacccactccagcccttgcctggagcctggcggaccagtgcatgccataggtactgaaggtgaatccagacgctgcacaggagagtccagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctctctcccagagcctccccgcgactggagtgatactaatcggagcaccggtcgtattagtaagactgatggcgcgagggagggcgatacg

SEQ ID NO: 792386 - DNA, 691 bp, Homo sapiens
  misc_feature: 50760.44.71.G05.1.pb.heavy.1.raw 50760
ctatgcgcctgccagcccgctcagacagtatataggaagtagtccttgaccaggcagcccagggccgctgtgccccagaggtgctcctggagcagggcgccagggggaagaccgatgggcccttggtggaagctgaagagacggtgaccattgtccctggccccaaatatcaaatgcatcgacgtcccaggatcgcctggcgcagtatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaaagtgataatcactaagactgaatcctgagactacacaggagagtctcagagaccgccctggctgtgccaagcccccccccgactccgccagtcgcccctcgcactggacaccttctaaaaaaactacaaggaaaatcagattagccaaactccatggttggtggtctgtgctcagtgctgatcaccaagtggaaactcctgggaatctcacggctggggctcctctctcttgcgacgacactaaatcgagcaccggtcgtgtatatactgtctgatggcgcgagggaggcgatacg

SEQ ID NO: 792387 - DNA, 705 bp, Homo sapiens
  misc_feature: 50763.44.36.D03.1.pb.heavy.1.raw 50763
ctatgcgccttgccagcccgctcagacagtatataggaagtagtccttgaccaggcagcccagggccgctgtgctctcggaggtgctcctggagcagggcgccagggggaagaccgatgggcccttggtggaggctgagggagacggtgaccagggttccctggccccagtggacagttcctgatataaacacaacacaataatacatgcccgctgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaatacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatac

SEQ ID NO: 792388 - DNA, 605 bp, Homo sapiens
  misc_feature: 50811.UNK.UNK.UNK.pb.heavy.1.raw 50811
ctatgcgccttgtcagcccgctcagacagtatataggaagtagtccttgaccaggcagcccagggccgctgtgcccccagaggtgctcctggagcagggcgccaggggaagaccgatggccttggtggaagctgagagacggtgaccgtgtccttggccccagacgtccataccgtagtagtagtatgcaactcccgaactccgcaccggctcttgcacagtaatacacagccgtgtcctcgggctctcagactgttcatttgcagatacagcgtgttcttggcgttggtctctggaatggtgaatcggcccttcacggggtccgcgtagcttgtgctactccatcactattaatacgtgagacccacaccagccccttccctgggcttggcgacccagtgcatccagtagctactgaaggtgaatccagaggctgcacaggagagtccagaccccccaggctgaactaagcctcccggactccaccagctgcacctcacactggacaccttttaaatagcaacaaagaaacccagctatcagatactaaatcgagcaccggggtcgtgtatatactgtctgatggcgcgaggggaggcgatacg

SEQ ID NO: 792389 - DNA, 697 bp, Homo sapiens
  misc_feature: 50817.UNK.UNK.UNK.pb.heavy.1.raw 50817
cgtatcgcctcccctcgcgccatcagacagtatatacacgacggtgctcgatttagctgcgtcacgatctctcttggggagctctgagagcggagccccagcccagattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctgattcaccatcagtgaccactatatggactgggtccgccaggctccagggaaggggctgagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccccaaggcccatcggtcttccccctggcgcctgctccaggagcacctccgagagcacagcggccctgggctgcctggtcaaggactacttcctatatactgtctgagcgggctggcaaggcgcatag

SEQ ID NO: 792390 - DNA, 698 bp, Homo sapiens
  misc_feature: 50923.UNK.UNK.UNK.pb.heavy.1.raw 50923
ctatgcgcctttgccagcccgctcagacagtatataggaagtagtccttgaccaggcagccagggccgctgtgctctcggagggtgctcctggagcagggcgccagggggaagaccgatgggccctttggtggaggctgaggagacggtgaccagggttccctggccccagtgacagtctcctgatataaacacaacacaataatacatgcgtgtcctcggttttcagcgttagtcattcgcagaatcaatggagttcttgaagtcatctcttgagagggtgaatctggctttcacaggacgcggcgtactctgtgataaagctggcaactttgtttttactgcggccaagccactccagccccttccctggagcctggcggacccagtccatatagtgggtcactgatggtgaatccagaggcgacacaggagagtctcagggaccctccaggctggaccaagtctcccccggactccaccactgcacttcactctgacaccttgtaaaataacacaaggaaaacccagctcagcccgaactccatgtgagtcctctgtgttcagtgctgatcaccaaatgaaaacacctgggaattctggggctgggctccgctctcccccaagagagatcgtgacgcagctaaatcgagcaccggtgtgtatatactgtcctgatggcgcgagggaggcgatacg

SEQ ID NO: 792391 - DNA, 616 bp, Homo sapiens
  misc_feature: 50960.UNK.UNK.UNK.pb.heavy.1.raw 50960
cccgacacgcttgctagggacttggagctaaggacgacatattgcctttagacagtcgaaggtgacgccttagctaccactgaacgtttaggcgccagatgcgcgtctgggatgacctaactcggcagcttatcgatgatctactgcacgctcaaccaaccaggtcttgatgcgcgcgataggactgacgggatcgctacagacatttaacttcgctagtaacttaattgagatcctaggggatgggataggaaatagaatccacccctatcacccccgcccacatagcctgcttggggtgttgagtttacttttattttcgtgttggaatgagttgaacttccgggaagtggagtaatgggtttgttacttcccctaaccgcaaagtactagttttacgagtggcgttgcaagccatagccagtcacaggtaataaacaattcaacgtggcgtaaagattggccgccgttgctgtggggcattgcaagctgggtttgcagcattgtgcatgctagacgacaatatgaatctgcgggacccctagtggccaagatggccgctagcggttccgcagctttgacctggaccaggggtgcatagcctgcccagccttcc

SEQ ID NO: 792392 - DNA, 626 bp, Homo sapiens
  misc_feature: 50974.44.36.D03.1.pb.heavy.1.raw 50974
cgtatcgcctcctcgcgccatcagacagtatatacacgaccggtgctcgatttagctgcgtcacgatctctcttgggagctctgagaggcggaggccccagccccagaattcccaggtgttttcatttggtgatcagcactgaacacagagggactcaccatggagttcgggctgagctgggtttttccttgttgttattttacaaggtgtccagagtgaagtgcagttggtggagtccgggggagacttggtccagcctggagggtccctgagactctcctgtgtcgcctctggattcaccatcagtgaccactatatggactggggtccgccaggctccaggaagggctggagtggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtcactggggccagggaaccctggtcaccgtctcctcagcctcccaagggcccatcggtcttccccctggcgccctgctccaggagcacctccga

SEQ ID NO: 792393 - DNA, 716 bp, Homo sapiens
  misc_feature: 51018.UNK.UNK.UNK.pb.heavy.1.raw 51018
ctatgcgccttgccagcccgctcagacagtatataggaagtagtcttgaccaggcagcccagggccgctgtgccccagaggtgctcctggagcagggcgccagggggaagaccgatgggcccttggtggaagctgaagagacggtgaccattgtcccctggcccaaatatcaaatgcatcgacgtcccaggatcgcctggcgcagttaatagacgcctgtgtcgtcggggtctcaggttgctcatttgtaaatggccaacactgttggagtcccatccctttgagacggtggaatcttccttcacagacgcggcgtactctttacttccaccataaacgtttcattctgacgaaagtgatccactcaagccccttccctggagcctgacggacccaggccaagtgataatcactaagactgaatcctgagactacacaggagagtctcagagaccgccctggctgtgccaagccccgactccgccagtcgccccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcaagacgtctgctaaatcgagcaccggtcgtgtatatactgtctgatggcgcggagggaggcgatacg

SEQ ID NO: 792394 - DNA, 711 bp, Homo sapiens
  misc_feature: 51047.UNK.UNK.UNK.pb.heavy.1.raw 51047
cgtatcgcctccctcggcgccatcagacagtatataacgaccggtgctcgatttagtgctatagacttggttggggagctctgggagaggagcccagcaccagaagtcggcggtgttcccagtcggtgatcagcaccgaacacagaggactcaccatggagtttgggctgacctgggttttcctcgtgctcttttaagaggtgtccagtgtcaggtgaagctggtggagtctggggaggcgtggtccagccctggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagaccaattcgaagaacacactatatctggaaatgaatagcctgagagccgaggacaccgggctggtctactactgtgcgaggagatggggctcgtggatacagatatggacatgctctactccaatggtatggacgcctgggccaaggggaccacggtcgccgtctcctcagcctccccaagggcccatcggtcttcccctggcacctcctccaagagcacctctggggcacagcggccctgggctgccctggtcaaggactacttcctatatactgtctgagcg

SEQ ID NO: 792395 - DNA, 714 bp, Homo sapiens
  misc_feature: 51054.44.55.E11.1.pb.heavy.1.raw 51054
cgtatcgcctccccctcggcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggaaggggctggagtgggtctcagtcatttatactggtgatttcacatactacgcagactccgtgaagggccgattcaccatcctccagggacaattccaggaaccacggtttatcttcaaatgaacaacctgagaggcgacgaccacggccgtctattactgtgcgagacaagtcggcgctcgagtggttattattcgtttgacttctggggccagggaaccctggtcacccgtcgcctccgcctccaccaagggccatcggtcttcccctggccaccctcctccaagagcacctctgggggcacagcggccctgggctgcctgggtcaaggactacttcctatatactgtttctgagcgggctggcaaggcgcatag

SEQ ID NO: 792396 - DNA, 692 bp, Homo sapiens
  misc_feature: 51081.UNK.UNK.UNK.pb.heavy.1.raw 51081
ctatgcgccttgccagcccgctcagacagtatataggaagtagtccttgaccaggcagccagggccgctgtgcccccagaggtgctcctggagcagggcgccagggggaagaccgatgggcccttggtggaagctgaggtgacaatgacagggttccctgcccccagatctcaaggctccatgcgagctggggttacggacctctcgccagtagtagacggccgtgtcgtcggatttcaagaaactcattgtcatggagactgtgtctgtggacttgtccgcggtaatcgtaattctgccccgaagtctcgtgcgtaggtgagtgagccaaaaagagggatgattcccacccatccactcaagcccttgtccaggggcctggcgcacccagttgatggtataagtagtggaactggtagtacttccagagccgtgcaggaaagggtcaccgaggaccaaggttgcggcattctagttcccagactgcaccagttgcaccagggactggacacctgttgctgctgcccacacaaagaggaacctccaggtccagtccatgggtgatgagctgtgctcccaggggcttcttagaggaggaatgtggtttgttatgtgatgctccccctgatagagctactaaatcgagcaccgtcgtgcatatactgtctgatggcgcgagggaggcgatacga

SEQ ID NO: 792397 - DNA, 689 bp, Homo sapiens
  misc_feature: 51150.44.72.G06.1.pb.heavy.1.raw 51150
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttccctgaccccagtagtcaatgagccacccagcgccctcccgcacaataatacacagccgtgtcctcgactctcagactgttcatttgcagatacagtgagttcttgcgttgtctctggagatggtgaatcggcccttcacagagtccacatagtgtgtctcagttccatctttcttcatgatggccacccactccagcccttccctggagcctggcggacccagttcatccaataactactaaaggtgaatccagaggctgcacaggagagtctcagggacccccccaggctggaccaagcctccccagactccaccagttgcacctcacactggacaccttctaaatagcaacaaggaaaaccagctcagtcccaattccatggtgagtcctctgtgctcagtgctgatcaccaagtggaaaggccttggagtccagggctaaggctcctctctcccctttcccttgcagtcgtagctaaatcgagcaccggtcgtgtatatactgtctgatggcgcgagggaggcgatacg

SEQ ID NO: 792398 - DNA, 683 bp, Homo sapiens
  misc_feature: 51211.UNK.UNK.UNK.pb.heavy.1.raw 51211
ctatgcgccttgccagcccgctcagacagtaatataggaagtagtccttgaccaggcagcccagggccgctgtgctctcggaggtgctcctggagcagggcgccagggggaagaccgatgggcccttggtggaggccgaggagacggtgaccagggttccctggccccagcgtcgaatgaaccgattttggaaacagatagtctcgcacaaaatacacggcgtgtcctgagtctcaggctgttcatttgaagagacactggtttctcggaatgtctctggagatggtgatcggccctccggaatcaccgtacttgatttcctccatgaaatgacacaccgcacccggccgccgtgccgtggagcctggcggaccccactgcatattccatatcgaaggtgaatccagaggctgcacaggagagtctcagggacccctactggggccacgcctcccagactccagaattgcacctgacacatgacacctctttaagagggcaacgaggaaaaccagctcagccaaactcatggtgattcctctgtgttcagtgatgatcaccgagtggaaacacggcgacttccagtgctgggctcgtcccaggcccccaaaccctttcgatcggcgtctaaatcgagcaccggtcgtggtatatactgtctgatggcgcgaggaggcgatacg

SEQ ID NO: 792399 - DNA, 603 bp, Homo sapiens
  misc_feature: 51242.UNK.UNK.UNK.pb.heavy.1.raw 51242
gaaggctgggcaggctatgcaccctggtccaggtcaaaagctgcggaacccgctagcggccatcttggcactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcagctatgtggggggtgatagggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 792400 - DNA, 683 bp, Homo sapiens
  misc_feature: 51262.44.45.E01.1.pb.heavy.1.raw 51262
ctatgcgccttgccagcccgctcagacagtatataggaagtagtccttgaccaggcagcccagggccgctgtgctctcggaggtgctcctggagcagggcgccagggggaagaccgatgggcccttgtggaggctgaggagacggtgaccagggctccctggccccagtagaacgatgggctcgtacaataatagagagccgagtccctcggctctcaaattgttcatttgtagatacacggtgttcttggaattgtctctggagacggagaatcggcccttcacggaggtttccatagtattctttacttccatcagaccagatgactgccacccactccagccccttgcctggagccttggcggaccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagccctttcccttactgactcactaaatcgagcaccggtcgtgtatatactggtctgatggcgcgaggaggcgatacg

SEQ ID NO: 792401 - DNA, 705 bp, Homo sapiens
  misc_feature: 51271.44.55.E11.1.pb.heavy.1.raw 51271
cgtatcgcctcctcgcgccatcagacagtatatacacgaccggtgctcgatttagcactcgcacgttgggtttggggagaggagcccagcactgggattccgaggtgtttccattcggtgatcagcactgacacagaggactcaccatggagttttggctgagctgggttctccttgttggacttttaaaaggtgttccagtgtgaggtgcggctgatggagtctggaggaggcttagtccagcctggggcggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctcccagggacaattccaggaacacggtttttatcttcaatgaacaacctgagagggcgacgacacggccgtctattactgtgcgagacaagtcggcgctcggagtggttattattcgtttgacttctgggggccaggaaccctggtcaccgtcgcctccgcctccaccaagggcccatcggtcttccccctggcaccctcctccaagagcacctctggggggcacagcggcctgggctgcctgtcaaggactacttcctatatactgtctgagcgggctggcaaggcgcatag

SEQ ID NO: 792402 - DNA, 562 bp, Homo sapiens
  misc_feature: 51276.44.78.H01.1.pb.heavy.1.raw 51276
cgtatcgcctccctcgcgccatcagacagtatatacacgaccggtgctcgatttagtgtgagtagtttgggtttgggtgccgaagttgctggaggtcacggtcaccacgctgctgaggtgagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtattctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaag

SEQ ID NO: 792403 - DNA, 673 bp, Homo sapiens
  misc_feature: 51283.44.6.A06.1.pb.heavy.1.raw 51283
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatcctcttttggctcactcacctacgcacgagacttccggggcagaattacgattaccgcggacaagtccacagacacagtctccatgacaatgagttctttgaaatccgacgacacggccgtctactactgttgcgagaggtccgtaccccagctcgcatggagcctttgagatctgggggcagggaaccctggtcattgtcacctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792404 - DNA, 702 bp, Homo sapiens
  misc_feature: 51292.44.55.E11.1.pb.heavy.1.raw 51292
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttcctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttcctggagcctggcggaccccaactcatgtagttgctgctgacggtgagcccagaggctgcacaggagagtctctggacccccaaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggagcgatacg

SEQ ID NO: 792405 - DNA, 574 bp, Homo sapiens
  misc_feature: 51293.44.78.H01.1.pb.heavy.1.raw 51293
cgtatcgcctccctcgcgccatcagacagtatatacacgaccggtgctcgatttagtgtgagtagtttgggtttgggtgccgaagttgctggaggtcacggtccaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792406 - DNA, 703 bp, Homo sapiens
  misc_feature: 51295.44.55.E11.1.pb.heavy.1.raw 51295
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792407 - DNA, 654 bp, Homo sapiens
  misc_feature: 51304.UNK.UNK.UNK.pb.heavy.1.raw 51304
cgtatcgcctccctccgcgccatcagacagtatatacacgacggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792408 - DNA, 724 bp, Homo sapiens
  misc_feature: 51331.UNK.UNK.UNK.pb.heavy.1.raw 51331
cgtatcgcctccctcggcgccatcagacagtatatacacgaccggtgctcgatttagtagttcgcataaagggaaaggggagctctgagagagggagcccagccctgggattttcaggtgtcttcatttggtgacaggaccgaacagagagaagtctccatggagtttgggctgagctgcctttttcttgtggttttttttaaagggtgtgcgtgtgtgaagtgcagttgttggagtctggggggggctgattcggccttcggcctgggaggtccctgaccctctcctgtgcggcctctggattcacctttagtgcctatggcatgacctgggtccgccgcggctcccagggaggggactggagtgggtctcaagtatcgagctggtggtgttcactttctacggagactccgtgaagggccgcttcaccatttccagggacaattcgcaggacaaattgtttctccaaatgaaaaacctgagacccgaggacacaggcgtctattactgtttgaaaagccaggacacggtgaccaccccatgacacctttagtacttggggccggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792409 - DNA, 725 bp, Homo sapiens
  misc_feature: 51358.44.33.C11.1.pb.heavy.1.raw 51358
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggcgaccgtggtcccttggcccaggcgtccataccattggagtagagcatgtcatatctgtatccacgagccccatctctcgcacagtgtagacagccgtgtcctcggctctcggctattcatttccagatatagtgtgttcttcgaattgtctctggagatggtgaatcggcccttcacggaatctacataatatttatttacttccatcataccatataagtgccacccactccagtcccttgcctggagcctggcggacccagtgcatgccatgtctgttgaaggtgaatccagacggctacacaggagagtctcagggacctcccaggctggaccacgcctcccccagactccaccagcttcacctgacactggacacctcttaaaagagcaacgaggaaaaacccaggtcagcccaaactccatggtgagtcctctgtgttcggtgctgatcaccgactggaaacaccgccgacttctggtgctggctcctctcccagccccaaacccaacgagctcactctaaatcgagcaccggtcgtgatagtatagactgatggcgcgagggagggcgatacg

SEQ ID NO: 792410 - DNA, 746 bp, Homo sapiens
  misc_feature: 51360.UNK.UNK.UNK.pb.heavy.1.raw 51360
ctatgcgccttgccagcccgctcagacagtatataggaagtagtccttgaccaggcagcccagggcgctgtgcccccagaggtgctcttggaggagggtgccagggggaagaccgatgggcccttggtgggaggctgaggagacggcgaccgtggtcccttggcccccaggcgtccataccattggagtagagcatgtcatatctgtatccacgagccccatctctcgcacagtagtagacagccgtgtcctccggctctcaggctattcatttccagaatatagtgtccgttcttcgaattgtctctgagatggtgaatcggcccttcaccggaatctacataatatttattacttccatcataccatataaagttggccaccccactccagtccttgcctggagccctggccggaccccagtgccatgccatgtctgttgaaggtgaatccagacgctacacaggagagtctcagcggacctcccaggctggaccacgctcccccagactccaccagcttcacctgacactgacacctcttaaaagagcaacgaggaaaacccaggtcagggcccaaactccatggtgagtcctctgtgttcggtgctgatcaccgactggcaacaccgccgacttctggtgctgggctcctctcccagagctccccaaaacccaacggaggctcactctaaatcgagcaccggtcgtgtatatactgtctgatggcgcgagggaggcgatacg

SEQ ID NO: 792411 - DNA, 694 bp, Homo sapiens
  misc_feature: 51392.44.67.G01.1.pb.heavy.1.raw 51392
cgtatcgcctcctcgcgccatcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagctctggctcaccgtcagcagcaactacatgagttgggtccgccaggctccagggaagggctggagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttcccctggcaccctcctccaagagcacctctggggcacagcggcctgggctgcctggtcaaggatacttcctatatactgtctgagcgggctggcaaggcgcatag

SEQ ID NO: 792412 - DNA, 658 bp, Homo sapiens
  misc_feature: 51416.UNK.UNK.UNK.pb.heavy.1.raw 51416
cgtatcgcctccctcgcgccatcagacagtatatacacgaccggtgctcgatttagagtgcctacgaagggaaaggggactcctgtgccccaccatggacacactttgctccacgctcctgctgctgaccatcccttcatgggtcttgtcccagatcacttgaaggagtctggtcctacgctggtgaagcccacacagaccctcacgctgacctgcaacctctctgggttctcactcaggagtgatggagcgattgtgggctgggtccgtcagcccccaggaaaggccctggagtggcttgcactcatttattgggatgatgataggcgctacagtccatctctgaagagcagactctccatcaccggagacgcctccaatacgcaggtgatccttagagtggccaacatggcccctgcggacacagccacatactactgcgcacacatgatcaactattataaaagtgtggttatgtgagtggctttgatatctggggccaagggacaatggtcaccgtctcttcagcctccacaagggcccatcggtcttcccctggcgccctgctccaggagcacctccgagagcacagcggccctggctgcctggtcaaggactacttcctatatactgtctgagcgggctggcaggcgcatag

SEQ ID NO: 792413 - DNA, 664 bp, Homo sapiens
  misc_feature: 51505.44.45.E01.1.pb.heavy.1.raw 51505
cgtatcgcctcctcgcgccatcagacagtatatacacgaccggtgctcgatttagtgagtcagtaaggaaagggctgggagaggagcccagcactagaagtcggcggtgtttccattcggtgatcagcactgaacacagaggactcaccatggagtttgggctgagctggttttcctcgttgctcttttaagaggtgtccagtgtcaggttcagctggtggagtctggggagcgtgccagctgggacgtccctgagactcctgtgttgcgtccggactcagttcagtgactctgccatgcactgggtccgccaggctccaggcaaggctggagtggtggcagtcatctgtctgatgaagtaaagaatactatggaaacccgtgaagggccgattctccgtctccagagacaattccaagaacaccgtgtatctacaaatgaacaattgagagcgaggactcggctctctattattgtacgagcccatcgttctactgggggccagggagccctggtcaccgtctcctcagcctccaccaagggcccatcggtcttcccctggcgccctgctccaggagcacctcccgagagcacagcggccctgggctgcctggtcaaggactacttcctatatactgtctgagcgggctggcaaggcgcatag

SEQ ID NO: 792414 - DNA, 575 bp, Homo sapiens
  misc_feature: 51510.44.78.H01.1.pb.heavy.1.raw 51510
ctatgcgccttgccagcccgctcagacagtatataggaagtagtccttggaccaggcagcccagggccgctgtgctctcggagggtgctcctggagcagggcgccaggggaagaccgatgggcccttggtggaggctgaggaggacgggtgaccagggttccctgccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaaagcccgtgttgccactatagggcttcatccatcccatccactccagcccttgtccagcggcctgtcgcacccagttaatatcataatgatgaacgtgtatccagaagccgtgcaggagactgtcactgaggccccaggcttcttcacctcagcagcgtggtgaccgtgacctccagcaacttcggcacccaacccaaactactcacactaaatcgagcaccggtcgtgtatatactgtctgatggcgcggagggaggcgatacg

SEQ ID NO: 792415 - DNA, 612 bp, Homo sapiens
  misc_feature: 51529.44.23.C01.1.pb.heavy.1.raw 51529
tatgcgccttgccagccgctcagacagtatataggaagtagtcctttgaccagcagccaggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggtttcatggacgtgtccctcgaaatggtgagacgactcttgagggacggagagtagtacgtcgcccagtataatggatgtcaccaatccactccattcccctccctgggggctgccggatccagcccaagaatgatcagaactgatggaaactccagagacagtgcagatgagagacaggttcccgaagcctcaccagtcctgggcccgactcctgcagctgcacctggacaggacccatctgggagctgccaccagcaggaggaaaaaccacaggtgtttcaccctgccccaatccctaatcacgtgtactaaatcgagcaccggtcgtgatagtatagactgatggcgcgagggaggcgatacg

SEQ ID NO: 792416 - DNA, 662 bp, Homo sapiens
  misc_feature: 51534.44.29.C07.1.pb.heavy.1.raw 51534
cgtatcgcctccctcgcgccatcagacagtatatacacgaccggtgctcgatttagagtgctacgagggaaagggggactcctgtgccccaccatggacacactttgctcacgctcctgctgctgaccatcccttcatgggtcttgtcccagatcaccttgaaggagtctgcgtcctacgctggtgaagcccacacagaccctcacgctgacctgcaacctctctgggttctcactcaggagtgatggagcgattgtgggctgggtccgtcagccccaggaaaggccctggagtggcttgcactcatttattgggatgatgataggcgctacagtccatctctgaagagcagactctccatcaccggagacgcctccaatacgcaggtgatccttagagtgccaacatggcccctgcggacacagcccacatactactgcgcacacatgatcaactattataaaagtggtggttatgtgagtggctttgatatctgggggccaaggacaatggtcaccgtctcttcagcctccaccaagggcccatcggtctttccctggcgccctgctccaggagcacctccgagagcacagcggccctgggcctgcctggtcaaggactacttcctatatactgtctgagcgggctggcaaggcgcatag

SEQ ID NO: 792417 - DNA, 534 bp, Homo sapiens
  misc_feature: 51556.UNK.UNK.UNK.pb.heavy.1.raw 51556
cgtatcgcctcctcgcgcatcagacagtatatacacgaccgtgctcgatttagtatctgatagttcagcctgggggtcctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcgggagttgcatactactactacggtatggacgtctggggccaagggaccacggtcaccgtctcctcagcttccaccaagggccatcggtcttcccctggcgccctgctcaggagcacctctgggggcacagcggccctgggctgcctggtcaaggactacttcctatatactgtctgagcggctggcaaggcgcatag

SEQ ID NO: 792418 - DNA, 737 bp, Homo sapiens
  misc_feature: 51566.44.27.C05.1.pb.heavy.1.raw 51566
ctatgcgccttgccagcccgctcagacagttatatataggaaagtagtccttgaccagggcagcccaggggccgctgtgctctcggaggtgcttcctggagcagggcgcccagggggaagaccgatgggccctttggtgggaggccgaggagacggtgaccagggtttcccctggcccccaggcgttcgaatgaaaccgattttgggaaacagatagtctcgcacaaaaaatacaccggccgtgtcctgaggtctctcagggctgttcatttgaaagagacactgtgttctcggaattgtctctggaagatggtgaatcggcccctcaacggaatcacccgtagacttgattttcctccatgaaatgacacacctgccacccactccagcccctcgcctggagcctggcggacccactgcatattccaattatcgaaggtgaatcccagaggctgcacaggagagtctcagggaccccccctactggggccacgcctccccccccagactccacgaattgcacctgacacatgacacctcttaaagagggcaacgaggaaaacccagctcagcccaaactccatggtgagtcctctgtgttcagtgatgatcaccgagtggaaacaccggcgacttccagtgctgggctcgtctcccagccccaaaccttcgatcgcgtctaaatcgagcaccggtcgtgtatatactgtctgatggcgcgagagggaggcgatacg

SEQ ID NO: 792419 - DNA, 689 bp, Homo sapiens
  misc_feature: 51584.44.71.G05.1.pb.heavy.1.raw 51584
cttgccagcccgctcagacagtatataggaagtagtccttgaccaggcagcccagggccgctgtgccccccagaggtgctcctggagcagggcgccaggggaagaccgatggcccttggtggaagctgaagagacggtgaccattgtcccctggccccaaatatcaaatgcatcgacgtcccaggatcgcctggcgcagtaatagacgccctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacaccttctaaaaaaaactacaaggaaaatcaagattagcccaaactccatggttggtggtctgtgctcagtgctgatcaccaagtggaaactcctgggaatctcacggctggggctcctctctcttgcgacgacactaaatcgagcaccggtcgtgttatatactgtctgatggcgcgagggaggcgataccg

SEQ ID NO: 792420 - DNA, 702 bp, Homo sapiens
  misc_feature: 51595.44.36.D03.1.pb.heavy.1.raw 51595
cgtatcgcctccctcgcgccatcagtctatactatcacgaccggtgctcgatttagctgcgtcacgatctctcttgggggagagcggagcccccagccccagaattcccaggtgttttcatttggtgatcagcactgaacacagaggactcaccatggagttcgggcttgagctgggttttccttgttgttattttacaaggtgtccagagtgaagtgcagttggtggagtccggggggagactggtccagcctggaggggtccctgagactctcctgtgtcgcctctggattcaccatcagtgaccactatatggactggggtccgccaggctccagggaagggctggagtggctggccgcagtaaaacaaagttgccagctttatcacagagtacgccgccgtctgtgaaagccagattcaccctctcaagagatgacttcaagaactcattgattctgcgaatgactaacctgaaaaccgaggacacgggcatgtattattgtgttgtgtttatatcaggaactgtccactgggggccagggaaccctggtcaccgtctcctccagcctccaccaagggcccatcggtcttcccctggcgccctgctcaggagcacctccgagagcacagcggccctgggctgcctggtcaaggactactttcctatatactgtctgagcgggctggcaaggcgcatag

SEQ ID NO: 792421 - DNA, 714 bp, Homo sapiens
  misc_feature: 51634.UNK.UNK.UNK.pb.heavy.1.raw 51634
cgtatcgcctcctcgcgccatcagacagtatatacacgaccgtgctcgattttagcactcgcacgttgggtttggggggggagaggagcccagcactgggattccgaggtgtttccattcggtgatcagccactgaacacagaggacttcaccatggagttttggctgagctgggttctccttgttggacttttaaaaggtgtccagtgtgaggtgcggctgatggagtctggaggaggcttagtccagcctggggggtcccagagactcttcctgtgcagcctctggctcaccgtcagcagcaactacatgagttgggtccgccaggctccagggaaggggctggagtgggtctcagtcatttatactggtgatttcacatactacgcagactccgtgaagggggccgattccaccatctccagggacaattccaggaacacggtttatcttcaaatgaaccaacctgaggaggcgacgccacgggccgtttttactgtgcgagacaagtcgcgctcggagtggttattattcgtttgacttctggggccagggaaccctggtcaccgtcgctccgcctccaccaacggccatcggtctttcccccctgcaccctcctccaaagagcacctctgggggcacagccggcccgggctgcctggttcaaggactacttcctatatactggtctgagcggcttggcaaggcgcatag

SEQ ID NO: 792422 - DNA, 699 bp, Homo sapiens
  misc_feature: 51652.44.36.D03.1.pb.heavy.1.raw 51652
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccagtggacagttcctgatataaacacacaacacaataatacatgcccgtgtcctcggttttcaggttagtcattcgcagaatcaatgagttcttgaagtcatctctgagagggtgaatctggctttcacagacgcggcgtactctgtgataaagctggcaactttgtttttaactgcggccaagccactccagccccttccctggagcctggcggacccagtccatatagtggtcactgatggtgaatccagaggcgacacagggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacaacctgggaattctgggctggggctccgctctccccaagagagatcgtgacgcagctaaatcgagcaccggtcgtgtatatactgtctgatggcgcgagggaggcgatacg

SEQ ID NO: 792423 - DNA, 701 bp, Homo sapiens
  misc_feature: 51655.UNK.UNK.UNK.pb.heavy.1.raw 51655
ctatgcgccttgccagcccgctcagacagtatataggaagtagtccttgaccaggcgccagggccgctgtgctctcggagtgctcctgggcaggggcgccagggggaagacgatggcccttggtggaggctgagagacggtcaccactgtcccccggcccaagtactaaaggtgtcatggggggtcaccgtgtcctggctttcaaacagtaatagacgcctgtgtcctcgggtctcaggtttttcatttggagaaacaatttgtcctgcgaattgtcctggaaatggtgaagcggccccttcacgggagtctccgtagaaagtgacaccaccgagcccctcgatacttgagacccccactccaggtccctccctggagcccggcggaacccaggtcatgcataggcactaaggtgaatccagaggccgcacaggagagggtcagggacctccaggccgaatcaggcccccccagactccaacaactgcacttcacacacgacacctttaaaaaagccgacaagaaaaggcagctcagccaaactccatggagactttctctctgttcggtcctggtcaccaaatgaaggacactgaaaatcccaggctgggctcctctctcagagctccctttcccttatgcgatactaaatcgagcaccggtcgtgtatatactgtctgatggcgcgaggaggcgatacg

SEQ ID NO: 792424 - DNA, 712 bp, Homo sapiens
  misc_feature: 51674.UNK.UNK.UNK.pb.heavy.1.raw 51674
cgtatcgcctccctcgcgccatcagacagtatatacacgaccggtgctcgatttagcactcgccacgttgggttttggggggagaggagcccagcactgggattccgaggtgtttccattcggtgatcagcactgaacacagaggactcaccatggagttttggctgaggctggggttctccttgttggacttttaaaaggtgtccagtgtgaggtgcggctgatggagtctggaggaggcttagtccagcctggggtccagagactctcctgtgcagccctccgcgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgaagaggcgacgacacggccgtctattactgtgcgagacaagtcggcgctcgagtggttattattcgtttgacttctggggccagggaaccctggtcaccgtcgcctccgcctccaccaaggcccatcggtctttccccctggcaccctccttccaagagcacctctgggggcacagcggccctgggctgcctggtcaaggactacttcctatatacctgtctgaagcgggctggcaaggcgcatag

SEQ ID NO: 792425 - DNA, 606 bp, Homo sapiens
  misc_feature: 51682.UNK.UNK.UNK.pb.heavy.1.raw 51682
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactgctatggcttgcaacgccactcgtaaaactagtactttgcggttagggaagtagacaaaccattactccacttcccggaagttcaactcattccaacacgaaataaaagtaaactcaacaccccaagcaggctatgtgggggggtgataggggtggatttctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792426 - DNA, 703 bp, Homo sapiens; identical to SEQ ID NO: 792406
  misc_feature: 51689.44.55.E11.1.pb.heavy.1.raw 51689

SEQ ID NO: 792427 - DNA, 689 bp, Homo sapiens
  misc_feature: 51708.44.21.B10.1.pb.heavy.1.raw 51708
ctatgcgcgccttgccagcccgctcgacagtatataggaagtagtccttgaccaggcagccaggggcgctgtgccccagaggtgctcctggagcagggcgccagggggaagaccgatgggcccttggtggaagctgaagaagacggtgaccattgtcccctggccccaaatatcaaatgcatcgacgtcccaggatcgcctggcgcagtaatagacgcctgtgtcgtcggtctcaggttgctcatttgtaaatggccaaccactgttggagtcatcccttgagacggtgaatcttccttcacagacgcggcgtactcttttacttccaccatacgtttcttctgacgaaagtgatccactcaagcccttccctggagcctgacggacccaggccaagtgataatcactaagactgaatcctgagactacacaggagagtctcagagaccgccctgctgtgccaagccccccccgactccgccagtcgcccctcgcactggacaccttctaaaaaaactacaggaaaatcaagattagcccaaactccatgttggtggtctgtgctcagtgctgatcaccaagtggaaactcctggaatctcacggctggggctccctctctctttgcgacgacactaaatcgagcaccggtcgtgtatatactgtctgatggcgcgagggagcgatacg

SEQ ID NO: 792428 - DNA, 678 bp, Homo sapiens
  misc_feature: 51720.44.36.D03.1.pb.heavy.1.raw 51720
ctatgcgccttgccagcccgctcagacagtatataggaagtagtccttgaccaggcagccaggcgctgtgctctcggaggtgctcctggaggcagggcgccaggggaagacgatggcccttggtggaggctgaggagacggtgccagggttccctggcccagtggacagttcctgatataacacaacacaataatacatgcccgtgtctcggttttcaggtttagtcatcgcagaatcaatgagttcttgaagtcatctcttgagagggtgaatctggctttcacagacgcgcgtactctgtgataaagctggcacttgttttactgcggccaagcactccgccccttccctggagcctggcggacccagtccatatagtggtcactgatggtgaatccagaggcgacacaggagagtctcaggaccctccaggcggacaagtctccccggactccaccaactgcacttcactctggacacctgtaaaataacaacaaggaaaacccagctcagcccgaactccatggtgagtcctctgtgttcagtgctgatcaccaaatgaaaacacctgggaattctggggctggggctccgctctccccaagagagatcgtgacgcagctaaatcgagcaccggtcgtgtatatactgtctgatggcgcgagggaggcgatacg

SEQ ID NO: 792429 - DNA, 712 bp, Homo sapiens
  misc_feature: 51727.44.85.H08.1.pb.heavy.1.raw 51727
cgtatcgcctccctccgcgccatcagacagtatatacacgaccggtgctcgatttagtatcactcagtcgcggggggagaggagcccagcactagaagtcggcggtgttccatcgtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactggtccgccaggctccaggcaaggggctgagtggggtggcacttatatggtatgatgaagtaataaatactatgcagactccgtgaagggccgattcaccatctccagagacaattccaagaacacgctgtatctgcaaatgaacagcctgagagccgaggacacgctgtgtattactgtgcgaggacatattgtagtactaccacctgctgggactactactacggtatggacgtctggggcaagggaccacggtcaaccgtctcctcagcctccaccaagggcccatcggtcttccccctggcaccctcctccaagagcacctctggggcaacgcggcctgggctgccctggtcaaggactaccttcctatatactgtctgagcgggcctggcaaggcgcatag

SEQ ID NO: 792430 - DNA, 628 bp, Homo sapiens
  misc_feature: 51831.44.23.C01.1.pb.heavy.1.raw 51831
cgtatcgcctccctcgcgccatcagacagtatatacacgaccggtgctcgatttagtacacgtgattagggattggggcaggtgaacactgtggtttttcctcctgctggtggcagctccagatgggtcctgtcccaggtgcagctgcaggagtcgggcccaggactggtgaggccttcgggaacctgtctctcatctgcactgtctctggagtttccatcagttctgatcattcttggggctggatcggcagcccccagggaggggaatggagtggattggtgacatccattatactggggcgacgtactactctccgtccctcaagagtcgtctcaccattcgagggacacgtcatgaaccgcttctccctgaaactgacctccgtgaccgtcgcgacacggccgtttatttctgtgcgaggcgagactcggtctttcaatcctattggggccgtcggcaccctggtccactgtctcctcagcttccaccaaggggccatcggtcttcgccctggcgccctgctccaggagcacctctggggggcacagcgggccctggaggctgcctggtcaaggactacacttcctacttcatactgtctgagcgcggctggcaaggcgcatag

SEQ ID NO: 792431 - DNA, 681 bp, Homo sapiens
  misc_feature: 51849.44.45.E01.1.pb.heavy.1.raw 51849
ctatgcgccttgccagccccgctcagacagtatataggaagtagtccttgaccaggcagccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgttctctggagacggagaatcggcccttcacggagtttccatagtattctttacttccatcagaccagatgactgccacccactccagcccttgcctggagcctggcggacccagtgcatggcagagtcactgaaactgagtccggacgcaacacaggagagtctcagggacgtccaggctggaccacgcctcccccagactccaccagctgaacctgacactggacacctcttaaaagagcaacgaggaaaaccccagctcagcccaaactccatggtgagtcctctgtgttcagtggctgatcacgaatggaacaccgccgacttctagtgctggggctcctctcccagccctttcccttactgactcactaaatcgagcaccggtcgtgtatatactgtctgatggcgcgagggaggcgatacg

SEQ ID NO: 792432 - DNA, 701 bp, Homo sapiens
  misc_feature: 51879.44.36.D03.1.pb.heavy.1.raw 51879
ctatgcgccttgccagccccgctcagacagtatataggaagtagtccttgaccaggccagcccagggccgctgtgctctcggaggtgctcctggagccagggcgccaggggaagaccgatgggcccttggtggaggctgaggagacggtgaccagggttcccctggccccagtggacagttcctgatataaacacaacacaataatacatgcccgtgtctcggttttcaggttagtcattcgcagaatcaatgagttcttgaagtcatctcttgagagggtgaatctggcttcacagacgcggcgtactctgtgataaagctggcaactttgtttttactgcggccaagccactccagccccttccctgagccctggcgacccagtccatatagtggtcactgatggtgaatccagaggcgacacaggagaagtctcagggaccctccaggctggaccaagtctgcccccggactccaccaactgcacttcactctggacaccttgtaaaataacaacaaggaaaaacccagctcagcccgaactccatggtgagtcctctgtgttcagtgctgatcaccaaatgaaaacacctgggaatttctggggctggggctccgctctccccaagagagatcgtgacgcagctaaatcgagcaccggtcgtgtatatactgtctgatggcgcgaggaggcgatacg

SEQ ID NO: 792433 - DNA, 682 bp, Homo sapiens
  misc_feature: 51885.UNK.UNK.UNK.pb.heavy.1.raw 51885
cgtatcgcctccctcgcgccaatcagacagtatatacaccgaccggtggctcgattagtgagtcagtaagggaaaggggctgggagaggagcccagcactagaagtcggcggtgtttccattcggtgatcagcactgaacacagaggactcaccatggagttgggctgagctgggttttcctcgttgctcttttaagaggtgtccagtgtcaggttcagctggtgagtctgggggaggcgtgtccagcctgggacgtccctgagactctcctgtgttgcgtccggactcagttcagtgactctgccatgcactgggtccgccaggctccaggccaaggggctggagtgggtggcagtcatctggtctgatggaagtaaagaatactatggaaactccgtgaagggcgattctccgtctccagagacaattccaagaacaccgtgtatctacaaatgaacaatttgagaggccgaggactcggctctctattattgtacgagcccatcgttctactggggccagggagccctggtcaccgtctcctcagcctccaccaaggggccatcggtcttccccctggcgccctgctccaggagcacctccgagagcacagcggccctgggctgcctggtcaaggactacttcctatatactgtctgagcgggctggcaaggcgcatag

SEQ ID NO: 792434 - DNA, 701 bp, Homo sapiens
  misc_feature: 51887.44.55.E11.1.pb.heavy.1.raw 51887
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 792435 - DNA, 691 bp, Homo sapiens
  misc_feature: 51892.UNK.UNK.UNK.pb.heavy.1.raw 51892
ctatgcgccttgccagcccgctcagacagtatataggaagtagtccttgacaggcagcccaggccgctgtgctctcggaggtgctcctggagcagggcgccagggggaagaccgatgggcccttggtggaggctgaggagacggtgaccagggttccctggccggaatgaaaccatcccagacagtaatagacggctgtgtcctcggtgttcaggctgttcatctgcaggagacaccgtatcttttgaatcatctcttgagatggtgaatctgcctttcacgggtgcagcgtagtctgctgtcccaccgtcagctttggttctaatacgggcaacccactccagccccttccccctggagcctggcggacccaggtcatccaggcgttttactgaaagtggatccagaggctgcacaggagaagtctaagggcactcccagggctttaccaaacctcccccagactccaccaactgcacctcacactggacacctttaaaatagcagcaggaaaatccagctcaagcccaaactccatggtgaagtcctctgtgttcagtcctgatccactgaatgaaaacacctgggaatccaaggctggggctcctctcccagagctcaacaccactctctctaaatcgagcacggtccgtgtaatatactggtctgatggcgcgagggaggcgatacg

SEQ ID NO: 792436 - DNA, 726 bp, Homo sapiens
  misc_feature: 51933.44.36.D03.1.pb.heavy.1.raw 51933
ctatgcgccttgccagccccgctcagacagtatataggaagtagtccttgaccaggcagcccaggccgctgtgctctcggaggtgctcctggagcagggcgccaggggggaagaccgatggggcccttgtggaggctgaaggagacggtgaccagggggttccccggccccagtagtcaaaaaccagccactgaccaagtggccccgattctcgaacagaagtagacagccgtgtcctcgtctctcaggctgttcatttccagatacagtgagttcttggcattgtccctggaattggtgaatcggcccttcacagagtctggcgtagtaggtggtatctccagcaatattaaacatatgaaaacccactccagcccccttcccctggagcctggcggacccagttcatggcatagtcactgaagatgaatccagaggctgcacaggagagtctcagggacccccaccgctgtaccaagcctcccccagactccaccagccgcacctcagcagtggacaccttctaaaatagcaacaaggaaaacccagcgcagccccaactccatggtgagtcctctgtgttcagtgctgatcaccaagtggaaatgccttggaatccaggggctaaggcacctctctgagagctccccaagagagatcgtgacgcagctaaatcgagcaccggtcgtggtatatactgtctgatggcgcgagggaggcgatacg

SEQ ID NO: 792437 - DNA, 700 bp, Homo sapiens
  misc_feature: 51952.UNK.UNK.UNK.pb.heavy.1.raw 51952
cgtatcgccccccctcgcgccatcagacagtatatacacgaccggtgctgatttagacgcgatcgaagggtttggggcctggagacgagccagcactggaagtcgccggtgtttccactcggtgatcatcactgaacacagaggactcccccatggagtttgggctgagctgggttttcctcgttgccctcttaagaggtgtcatgtgtcaggtgcaattcgtggagtctgggggaggcgtggcccagtaggggggtcctgagactctcctgtgcagcctctggattcaccttcgataattggaatatgcagtgggtccgccaggctcaggcgaggggctggagtgggtggcaggtgtgtcatttcatggaggaaatcaagtctacggtgattccgttgagggccgattcaccatctccagagaacaattccgagaacacagtgctccttcaaatgagaacagcctgagacctcaggacacggcgcgtgtattttgttgcgagactatctgtttccaaatccgggttcattcgacgccttggggccaggaacctggtcaccgtctctcggcctccaccaagggcccatcggtcttccccctggcgcctgctccaggagcacctccgagagcacagcggccctggctgcctggtcaaggactacttcctatatactgtctgagcggctggcaggcgcatag

SEQ ID NO: 792438 - DNA, 741 bp, Homo sapiens
  misc_feature: 51964.44.86.H09.1.pb.heavy.1.raw 51964
ctatgcgccttgccagcccgctcagaccagtatataggaagtagtccttgaccaggcagcccagggccgctgtgccccccagaggtgctcttggaggagggtgccagggggaagaccgatggcccttggtggagctgaggagacggcgaccgtggtccccttggcccaggcgtccataccattggagtagagcatgtcatatctgtatccacggagccccatctctcgcacagtagtagacagccggtgtcctcggctctcaggctattcatttccagatatagtgtgttcttcgaattgtctctggagatggtgaatcggcccctttcacggaatctacataatatttattacttccatcataccatataagtgccacccactccagtcccttgcctggagcctggcggacccagtgcatgccatgtctgttgaagggtgaatccagacgctacacaggagagtctcagggacctccccaggctggaccacgcctcccccagactccaccagcttcacctgacactggacacctcttaaaagagcaacgaggaaaacccaggtcagcccaaactccatggtgagtcctctgtgtttcggtgctgatcaccggactggaaacaccgccgacttctggtgctgggctcctctcccagagctcccccaacccaagtctatagcactaaatcgagcaccggtcgtgtatatactgtctgatggccgcgagggaggcgaaatacg

SEQ ID NO: 792439 - DNA, 739 bp, Homo sapiens
  misc_feature: 51973.44.85.H08.1.pb.heavy.1.raw 51973
cgtatcgcctccctccgcgccatcagacagtatatacacgaccggtgctcgatttagtatcactcagtcgcggggagctctgggagaggagcccagcactagaagtcggcggtgtttccatccggtgatcagcactgaacacagaggactcaccatggagtttgggctgagctgggttttcctcgttgctcttttaagaggtgtcagtgtcaggtggcagctggtgggagtctggggaggcgtgtccagcctggggaggtccctgaagactctcctgtgcagcgtctggattcaccttcagtacctatggcatgcactgggtccgccaggctccaggcaaggggctggaagggggtggcacttatatggtaatgatggaagtaataattactatgcagactccgtgaaggccgattcaccatcctccagaagacaattccaagaacacgctgtaatctgcaaatgaacagcctgagagccgaggacacggctgtggtattactgtgcgaggacatatttgtagtactaccacctgctggactatactacggtatggaacgtctggggccaagggacccacggtcccacccgtctccctcagcctccaccaagggccatcggtcttccccctgggcacccctccctccaagagcacctctggggggcacaagcggcctgggctgcctggtcaaggactacttcctatatactgtctgagcggggctggcaaggcgcatag

SEQ ID NO: 792440 - DNA, 616 bp, Homo sapiens
  misc_feature: 51976.UNK.UNK.UNK.pb.heavy.1.raw 51976
cccgacacgcttgctagggacttggagctaaggacgacatattggcctttagacagtcgaaggtgacgccttagctaccactgaacgttttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaaggggatgggataggaaatagaatccacccctatcaccccccccacatagcctgcttggggtgttgagtttacttttatttcgtgttggaatatggagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctggtttgcagcattgtgcatgctagacgacaatatgaatctgcgggaccctagtggccaaggatggccgctagcgggttccgcagcttttgacctggaccagggtgcataggccctgcccagccttc

SEQ ID NO: 792441 - DNA, 725 bp, Homo sapiens
  misc_feature: 51983.UNK.UNK.UNK.pb.heavy.1.raw 51983
cgtatcgccctccctcgcgccatcagacagtatatacacgaccggtgcctcgatttagcagacgtctgaacacacaaaggggagctctgggagaggagccccagccgtgagattcccaggagtttccacttgtgatcagcactgagcacagaccacccaaccatggagtttgggctaatcttgattttccttgtagttttttttagaaggtgtccagtgcgaggggcgactggcggagtcgggggggggcttggcacagccagggcgggtcctctgagactctcctgtgtagtctcaggattccagtcttagtgattatcacttggcctgggtcgtcaggcctccagggaaggggcttgagtggatcactttcgtcagaatgaaacgttatggtggaagtaaagagtacgccgcgtctgtgaagggaaagattcaccgtctccaagggatggactccaacagtgttggccatttacaaatgagcaacctgagaccgaccgacacaggcgtctattactgcgccaggcgatcctgggacgtcgatgcatttgatattttggggccaggggacaatggtcaccgtctcttcagcttccaccaaggcccatcggtcttcccctggcgccctgctccaggagcaccttctgggggcacagcggccctgggctgcctggtcaaggactacttcctatatactgtctgagccgggctggcaaggcgcatag

SEQ ID NO: 792442 - DNA, 697 bp, Homo sapiens
  misc_feature: 52008.44.27.C05.1.pb.heavy.1.raw 52008
ctatgcgcctgcagcccgctcagacagtatataggaagtagtccttgaccaggcagccagggcgctgtgctctcgaggtgctcctggagcagggcgccagggggaagaccgatgggcccttggtggaggccgaggagacggtgaccagggttccctggccccaggcgtcgaatgaaccgattttggaaacagatagtctcgcacaaaaaaatacacggccgtgtcctgaggtctcaggctgttcatttgagagacactgtgttctcggaattgtctctggagatggtgatcggccctcacggaatcaccgtagacttgattcctccatgaaatgacacacctgccacccactccagccctcgcctggagcctggcggacccactgcatattccaattatcgaaggtgaatccagaggctgcacaggagagtctcagggaccccctactgggccacgcctccccagactccacgaattgcacctgacacatgacacctcttaagagggcaacgaggaaaacccagctcagccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggagggcgatacg

SEQ ID NO: 792443 - DNA, 610 bp, Homo sapiens
  misc_feature: 52019.UNK.UNK.UNK.pb.heavy.1.raw 52019
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctaccagacatttaactcgctagtaaacttaattgagatccctagggatgggattaggaaatagaatccacccctatcacccccccacatagccctgcttggggtgttgagtttaccttttatttcgtgttggaatgaggttgaacttccggaagtggagtaatgggtttgtctacttcccctaaccgcaagtactagttttacggagtggcgttgcaagcatagccagtcacaggtaataaacaattcaacgtggcgtaaagattggccgcttgctgtgggcattgcaagctgggtttgcagcattgtgcatgctagacgacaatatgaaatctgcgggacccctagtggccaagatggccgctagcgggttccgcagcttttgacctggccagggtgcatagcctgccagcctc

SEQ ID NO: 792444 - DNA, 703 bp, Homo sapiens
  misc_feature: 52076.UNK.UNK.UNK.pb.heavy.1.raw 52076
cgtatcgcctccctcgccgccatcagacagtaatacacgacccggtgctcgatttagcagacgtctgaacacacaaaggggagctctgggagaggagccccagccgtgagattcccaggagtttccacttggtgatcagcactgagcacagaccacaaccatggagtttgggctaatcttgattttccttgtagtttttttagaaggtgtccagtgcgagggcgactggcggagtcggggggggcttgcacagccagggccggtctctgagactctcctgtgtagtctcaggattcagtcttagtgattatcacttggcctggtccgtcaggctccagggaaggggcttgagtggatcactttcgtcagaatgaaacgttatggtggaagtaaagagtagccgcgtctgtgaagggaagattcaccgtctcaagggatgactccaacagtgttggccatttacaatgagcaactgagaccgacgacacaggcgtctattactgcgccaggcgatcctgggacgtcgatgcatttgatatttggggcaggggacaatggtcaccgtctcttcagcttccaccaagggcccatcggtcttcccctggcgccctgctccaggagcacctctggggccagcgggccctgggctgcctgtcaaggactacttcctatatactgtctgagcggctggcaaggcgcatag

SEQ ID NO: 792445 - DNA, 547 bp, Homo sapiens
  misc_feature: 52086.44.43.D10.1.pb.heavy.1.raw 52086
cgtatcgcctccctcgcgcatccagacagtatatacacgaccggtgctcgatttagactagcagtaagggctgaggtgagaagcctggggcctcagtgaaggtctcctgcaaggcttctggatacaccttcaccaattatgatatcaactgggtgcgaccaggccactggacaagggcttgagtggagggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaaccctggtcaccgctcctcagcttccaccaagggcccatcggtcttccccctggcgccctgctccaggagcacctctgggggcacagcggccctgggctgcctggtcaaggacctacttcctatatactgtcgagcggctggcaaggcgcatag

SEQ ID NO: 792446 - DNA, 606 bp, Homo sapiens
  misc_feature: 52133.UNK.UNK.UNK.pb.heavy.1.raw 52133
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaatagaatccacccctatcaccccccccacatagcctgcttggggtgttgagtttacttttatttcgtgttggaatgagttgaacttccgggaagtggagtaatgggtttgtctacttccctaaccgcaaagtactagtttttagagtggcgttgcaagccatagccagtcacaggtaataaaacaattcaacgtggcgtaaagattggccgcttgctgtggcattgcaagctgggtttgcagcattgtgcatgctagacgacaatatgaatctgcgggacccctagtggccaagatggccgctagcgggttccgcagcttttgacctggaccagggtgcatagcctgccagccttc

SEQ ID NO: 792447 - DNA, 715 bp, Homo sapiens
  misc_feature: 52154.UNK.UNK.UNK.pb.heavy.1.raw 52154
cgtatcgcctcccctcgcgccatcagacagtatatacacggacccggtgctcgatttagagtatacatattgggtttggggggggaggagagcccagcactgggattccgagtgtttccattcggtgatcagcactgaaacacagaggactcaccatggagttttggctgaagctgggttctccttgttggacttttaaaaggtgtccagtgtgaggtgcggctgatggaggtctggaggaggcttagtccagcccctggggggtcccagagactctcctgtgcagcctctgggtcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaaggcgacgacacggccgtctattactgtgcgagacaagtcggcgctcggagtggttattattcgtttgacttctggggccagggaaaccctggtcaccgtcgcctccgcctccaccaagggcccatcggtcttcccctggcaccctcctccaagagcacctctgggggcacagcggccctgggctgcctggtcaaggactacttcctattatactgtctgagcgggctggcaagggcgcatag

SEQ ID NO: 792448 - DNA, 690 bp, Homo sapiens
  misc_feature: 52159.UNK.UNK.UNK.pb.heavy.1.raw 52159
ctatgcgccttgccagccgctcagacagtatataggaagtagtccttgaccaggcagcccagggccgctgtgctctcggaggtgctcctggagcagggcgcccagggggaagaccgatgggcccttggtgaggccgaggagacggtgaccgggttccctggccccagcgtcgaatgaaccgattttggaaacagatagtctcgcacaaaaatacacggcgtgtcctgagtctcaggcgttcatttgaagagacactgtgtctcgggaatgtctctggagatggtgatcgccctcaacgaatcaccgtagacttgattttcctccatgaaatgacacacctgcccccactccagcccctcgcctggagcctggcggacccactgcatattccaattatcgaaggtgaaccagaggctgcacaggagagtctcagggacccccctactggggccacgcctcccccagactccacgattgcacctgacacatgacacctcttaagagggcaacgaggaaacccagctcagcccaaactccatggtgagtcctctgtgttcagtgatgatcaccgagtggaaacaccggcgacttccagtgctgggctcgtctccaggcccaaaccttcgatcgcgtctaaatcgagcacggtcgtgtatataactgtctgatggcgccgagggaggcgatacg

SEQ ID NO: 792449 - DNA, 659 bp, Homo sapiens
  misc_feature: 52217.44.86.H09.1.pb.heavy.1.raw 52217
ctatgcgccttgccagcccgctcagacagtatataggaagtagtccttgaccaggcaggcccaggggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtccacggaggtcagtttccagggagaagcggttcatggacgtgtccctcgaaatggtgagacgactcttgagggacggagagtagtacgtcgccccagtataatggatgtcaccaatccactccattcccctccctggggggctgccggatccagccccaagaatgatcagaactgatggaaactccagagacagtgcagatgagagacagggttcccgaaggcctcaccagtcctgggcccgaactcctgcagctgcacctgggacaggacccatctgggagctgccaccagcaggaggaaaaaccacaggtgcttcatgttcttgcacaggaggtccttgactctcagaaaagcatccccaaacccaagtctatagcactaaatcgagcaccggtcgtgttatactgtctgatgcgcgagggaggcgatacg

SEQ ID NO: 792450 - DNA, 603 bp, Homo sapiens
  misc_feature: 52233.UNK.UNK.UNK.pb.heavy.1.raw 52233
aaggctgggcaggctatgcaccctggtccaggtcaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatgcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggatctatttcctatcccatcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792451 - DNA, 640 bp, Homo sapiens
  misc_feature: 52264.UNK.UNK.UNK.pb.heavy.1.raw 52264
cgtatcgcctccctccgcgccatcagacagtatatacgacgaccggtgctcgatttagtacacgtgattagggattgggggcagggtgaacacctgtggttttcctcctgctggtggcagctccagatgggtccttagtcgctcaggtgcagctgcaggagtcgggcccaggactgagatggtgaggccttcgggaaccctgtcttctcatctgcactgtctctggagttcgcatcagttctgatcattcttgggactggatccggcaagcccccagaggtggaatggagtgattggtgacatccattatactggggcgacgtactactctccgtcctcaagagtcgtctcaccatttcgagacaggcgtccccgtccatgaaccagcttctccacctgaaactgacctcccgtgaccgcgcgacacgccgtttattctgtgcgaggcgagactggtctttcaatcgatagggccgtagcaaccctggtcactgtctcctcagcttccaccaagggccccatcggtcttccccctggcgcctgctccaggagcacctctgggggtgacacagcggccctgggctggcctggtcaaggactacttcctatatactgtctgagcgggctggcaaggcgcata

SEQ ID NO: 792452 - DNA, 699 bp, Homo sapiens
  misc_feature: 52301.UNK.UNK.UNK.pb.heavy.1.raw 52301
cgtatcgcctcctcgcgccatcagacagtatatacacgacggtgctcgattttagctgcgtcacgatctctcttgggggagagcggagccccagccccagaattcccaggtgttttcattggtgatcagcactgaacacaagaggactcaccatggagttcgggctgagctgggttttccttgttgttattttacaaggtgtccagagtggaagtgcagttggtggagtccgggggagactttggtccagcctggagggtccctgagactctcctgtgtcgcctctggattcaccatcagtgaccactatatggactgggtccgccaggctccagggaaggggctggagtggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgttatatcaggaaactgtccactgggccagggaacccctggtcaccgtctctcagcctccaccaagggcccatcggtcttccccctggcgccctgctccaggagcacctccgagagcacagcggccctgggctgcctggtcaaggactacttcctatataactgtctgagcggggctggcaggcgcatag

SEQ ID NO: 792453 - DNA, 568 bp, Homo sapiens
  misc_feature: 52335.44.78.H01.1.pb.heavy.1.raw 52335
catgcgccttgccagcccgctcagacagtatataggaagtagtccttgaccaggcagcccagggccgctgtgctctcgggaggtgctcctggagcagggcgccaggggaagaccgatgggcccttggtggaggctgaggagacggtgaccagggttccctggcccacaagtcaagccaggtgctggtggctctcgcacagaaataacacggccgtgtcctcagatctcaggctgctcagttccatgtagactgtacctggggaggtgctcctggtcatactaactctgcttgaacttctgggcaaagcccgtgttgccactatagggcttcatccatcccatccactccaagccccttgtccagcggcctgtcgcaccagttaatatcataattgatgaacgtgtatccagaagccgtgcaggagactgtcactgaggccccaggcttcttcacctcagcagcgtggtgaccgtgacctccagcaacttcggcaccaaacccaaactactcacactaaatcgagcaccggtcgtgtatatactgtctgatgcgcgagggaggcatacg

SEQ ID NO: 792454 - DNA, 649 bp, Homo sapiens
  misc_feature: 52343.UNK.UNK.UNK.pb.heavy.1.raw 52343
cgtatcgcctccctcgcgccatcagacagtatatacacgaccggtgctcgatttagttgtgtagattccgcgggggctttctgagagtcatggacccctgtgcaagaacatgaagcacctgtggttcttcctcctgcggggcggctcccgatgggtcctgtcccagctgcagctgcaggagtcgggcccaggactggtgaagccttcgggaccctgtccctcacctgcacgtctctcggggctccatcagcagtagtagttactactggggctggatccgccagccccagggaaggggctggagtgattgggagtatctattatagtgggagcacctactacaacccgtccctcaagagtcgagtcaccatatcagtagacacgtccaagaaccagtctccctgaagctgagctctgtgaccgccgcggacacggccgtgtattactgtgcgagagtagggcagttcgtcaccaactactttgaccactggggccaggacccggtcaccgtctcctcagcctccaccaagggcccatcggtcttcccctggcaccctcctccagagcacctctggggcacagcggccctgggctgcctggtcaaggactactcctatatactgtctgagcgggctggcaaggcgcatag

SEQ ID NO: 792455 - DNA, 725 bp, Homo sapiens
  misc_feature: 52388.UNK.UNK.UNK.pb.heavy.1.raw 52388
ctatgcgccttgccagcccgctcaagacagtatataggaagttagtccttgacccaggcagcccagggccgctgtgcccccagaggtgctcttgaggagggtgccagggggaagaccgatgggcccttggtggaggcggaggcgacggtgaccagggttcctggccccaagaaatccaacaacgaaataataaccactccgagcgccgacttggctcgcacagtaataagacggccgtgtcgtcgcctctctcaggttgtttcatttgaaagataaccgtggtttcctggaattggtccctggagaatggtgaatcgcccttcaacggagtctgcgtgtatgtgaaaatcaccaagtataaatgaactgagacccactccagccccttccctggagcctggcggacccaactcatgtagttgctgctgacggtgagcccaagaggctgcacaggagagtctctgggaccccccaggctggactaagcctcctccagactcccaatcagccgcacctcacactggaccctttttaaaagtccaacaaaggagaacccagctcagcaaaactccatggtgagtcctctgtgttcagtggctgatcaccgaatggaaacaacctcggaatcccagtgctgggctcctctccccaaacccaacgtgcgagtggctaaatcgagcaccggtcgtgtatatactgtctgatggcgcgagggaggcgatacg

SEQ ID NO: 792456 - DNA, 679 bp, Homo sapiens
  misc_feature: 52389.44.73.G07.1.pb.heavy.1.raw 52389
cgtatcgcctccctcgcgccatcagacagtatatacacgaccggtgctcgattagctctacgctcaggggggggagacgagcccagcactggaagtcgccggtgtttccattcgtgatcatcactgacacagagactcaccatggactttggctgagatgggttttcctcgttgctcttttaagaggtggccagtgtcaggtgcagctagtggagtctggggaggagcggcccagcctgggaactccctgagactctcctgtgcagcctctggattcatcttcaggacctatgcatgcactggtcgccaggctccaggcaaggctggatggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagcccccctcgagacggtccccgcttgactactggggccagggaaccctggtcaccgtctcctcagcctcaccaagggcccatcgcggtcttccctggcgccctgctccaggagcacctccgagagcacagcgccctgggctgcctggtcaaggactacttcctatatactgtctgagcggctggcaaggcgcatag

SEQ ID NO: 792457 - DNA, 734 bp, Homo sapiens
  misc_feature: 52413.UNK.UNK.UNK.pb.heavy.1.raw 52413
ctatgcgcctttgccagccccgctcagacagtatatagggaagtagtccttgaccaggcagcccagggccgctgtgcccccagaggtgctcttggaggaggtgccagggggaagaccgatgggcccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttcttggtgctgggctcctctcccagagctccccaacccaagtctatagcactaaaatcgagcaccgtcgtgtatatactgtctgatggcgcgagggaggaggcgatacg

SEQ ID NO: 792458 - DNA, 637 bp, Homo sapiens
  misc_feature: 52416.44.86.H09.1.pb.heavy.1.raw 52416
cgtatcgcctcctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctccagatggtcctgtccaggtgcagctgcaggagtcgggcccaggactgtgaggccttcggaaccctgtctctcatctgcactgtctctggagtttcatcagttctgatcattcttgggctggatccggcagcccccagggagggaatggagtggattgtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgagcgagactggtctttcaatctatggggccgtggcaccctggtcactgtctcctcagcttccaccaaggcccatcggtcttccccctggcgcctgctccaggagcacctctggggcacagcggccctggctgcctggtcaggactacttcctatatactgtcgagcgggctggcaaggcgcatag

SEQ ID NO: 792459 - DNA, 633 bp, Homo sapiens
  misc_feature: 52458.44.86.H09.1.pb.heavy.1.raw 52458
cgtatcgctcctcgcgcatcagacagtatatacacgaccggtgctcgatttagtgctatagactggtttgggatgctttctgagagtcaaggactcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattctggggctggatccggcagccccagggaggggaatggagtggattggtgacatccattatactgggcgacgtactactctccgtcctcaagagtcgtctcaccatttcgaggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggccatcggtcttcccctgggccctgctccaggagcacctctggggcacagcggccctggctgcctggtcagactacttcctatatactgtctgagcggctggcaaggcgcatag

SEQ ID NO: 792460 - DNA, 652 bp, Homo sapiens
  misc_feature: 52473.44.12.B01.1.pb.heavy.1.raw 52473
ctatgcgccttgcagcccgctcagacagtatataggaagtagtccttgaccaggcagccagggccgctgtgccccagaggtgcctcttggaggagggtgccaggggaagaccgatgggcccttggtgggggctgaggagacggtgaccagggttccctgccccagtgtgcaaagtagttggtgacgaactgccctactctcgcacagtaatacacggccgtgtccgcggcggtcacagagctcagcttcagggagaactggttcttggacgtgtctactgatatggtgactcgactctgagggacgggttgtagtaggtgctccactataatagatactcccaatccactcagcccttccctgggggctggcggatccagcccagtagtaactactactgctgatggagccaccagagacagtgcaggtgagggacagggtctccgaaggcttcaccagtcctggcccgactcctgcagctgcagctgggacaggacccatctggagccgccaccagcaggaggaagaaccacaggtgcttcatgttcttgcacaggaggtccatgactctcagaaagcccccgcggaatctacactactaaatcgagcaccggtcgtgatatactgtctgatggcgcgagggggcgatacg

SEQ ID NO: 792461 - DNA, 595 bp, Homo sapiens
  misc_feature: 52475.UNK.UNK.UNK.pb.heavy.1.raw 52475
gaaggctggcaggctatgcaccctggtccaggtcaaagctgcggaacccgctagcggccatcttggccactaggggtcccgcagattcatattgtcgtctagcatgcacaatgctgcaaaccagcttgcaatgccacagcaagcggccaatctttacgccacgttgaattgtttattacctgtgactggctatggcttgcaacgccactcgtaaaactagtactttgcggttagggaagtagacaaaccattactccacttccggaagttcaactcattccaacacgaaataaaagtaaactcaacaccccagcaggctatgtggggggtgatagggtggattctatttcctatcccatccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 792462 - DNA, 663 bp, Homo sapiens
  misc_feature: 52497.UNK.UNK.UNK.pb.heavy.1.raw 52497
ctatgcgccttgccagcccgctcagacagtatataggaagtagttccttgaccaggcagccccagggcccgctgtgccccagaggtgctcctggagcagggcgccagggggaagaccgatgggcccttggtggaagctgagggacaggtgaccagggtgccacggcccccatagattgaaagaccagtctcgcctcgcacagaaataaacgccgtgtccgcgccgggcgtcacggaggtcagtttcagggagaagcggtcatggacgtgtccctcgaaatggtgagacgactcttgagggacggagagtagtacgtcgccccagtataatggatgtcaccaatccactccattccctccctggggctgccggatccagccccagaatgatcagaactgatggaaactccagagacagtgcagatgagagacagggttcccgaaggccctcaccagtcctgggccccgactcctgcagctgcacctgggacaggacccatctggaggctgccaccagcaggaggaaaaacccaggtggcttcatgttcttgcacaggaggtccttgactctcagaaagcatccccaaacccagagtctatagcactaaaatcgagcaccggcgtcggtgtatatactcgctgatggcgcgagggaggcgatacg

SEQ ID NO: 792463 - DNA, 710 bp, Homo sapiens
  misc_feature: 52501.UNK.UNK.UNK.pb.heavy.1.raw 52501
cgtatcgccttccctcgcgccatcagacagtatatacacgaccggtgctcgatttagcactccgcacgttgggtttggggggggagaggagccagcactggattccgagtgttttccattcggtgatcagcactgaacacagaggactcaccatggagtttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtcgccaggctccagggaagggcccggagtgggtctcagtcatttatactggtgttttcacatactacgcagactccggtgaagggccggattcaccatctccagggacaatcgccaggaacacggtttatcttcaaatgaacacctgagaggcgacgacacgggccgtctattactgtgcgagacaagtcgcgctcggagtggttattattcgtttgacttctgggccagggaaccctggtcaccgtcgcctccgcctccacgcaagggcccatcggtcttccccctggcacccctcgctccaagagcacctctggggcacagcggccctgggctgcctggtcaaggactacttcctatatactgtctgagcgggctggcaaaggcgcatag

SEQ ID NO: 792464 - DNA, 712 bp, Homo sapiens
  misc_feature: 52508.UNK.UNK.UNK.pb.heavy.1.raw 52508
ctatgcgccttggccagcccgctcagacagtatattaggcaagtagtccttgaccaggcagcccagggccgctgtgcctctcgaggtgctcctggagcagggcgccagggggaagaaccgatggccctttaggtggaggccggaggagaacggtgaccagggttccctggcccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgccacctgacacatgacacctcttaagagggcaacgaggaaaacccagctcagcccaaactccatggtgagtcctctgtgttcagtgatgatcaccgagtggaaacaccggcgacttccagtgctgggctcgtctcccagcccaaacccttcgatcgcgtctaaatcaagcaccggtcgtgtatatactgtctgatggcgcgagggaggcgatacg

SEQ ID NO: 792465 - DNA, 678 bp, Homo sapiens
  misc_feature: 52519.UNK.UNK.UNK.pb.heavy.1.raw 52519
ctatgcgccttgccaggcccgctcagacagtatataggaagtagtccttgaccaggcagcccagggccgctgtgcccccagaggtgctcctggagcagggcgccaggggaagaccgatgggccttggtggaagctgaggtgacaatgaccagggttccctgccccagatctcaaaggctccatgcgagctggggtacggacctctcgcacagtagtagacggccgtgtcgtcggatttcaaagactcattgtcatggagactgtgtctgtgactgtccgccggtaatcgtaattctgccccggaagtctcgtgcgtagtgagtgagccaaaaagagggatgattcccacccatgccactcaagcccttgtcaggggcctggcgcaccagtgatggtataagtagtgaactggtagtacttcagagccgtgcaggagaaagggtcaccgagaccaaggttgcggcattctagtccatgactgcccagtttgcaccagggactggacacctgtgctgctgcacacaaagaggaacctccaggtccagtccatggtgatgagctgtgctcccagggcttctttagaggaggaatgtggttgttatgtgatgctccccctgatagagctactaatcgagcaccgtcgtgtatatactgtctgatggcgcgaggaggcgatac

SEQ ID NO: 792466 - DNA, 708 bp, Homo sapiens
  misc_feature: 52549.UNK.UNK.UNK.pb.heavy.1.raw 52549
cgtatcgcctccctcgcgccatcagacagtatatacacgaccggtgctcgattagtttagtcgcataagggaaaggggagctctgagagaggagcccagccctggggattttcaggtgtcttcatttggtgaccaggaccgaacagagagaagtctccatggagtttgggctgagctgcctttttcttgtggcttttttaaagggtgtcgtgtgtgaagtgcagtgttggagtctgggggggcctgattcggcctgggaggtccctgacccctctcctgtgcggcctctggattcacctttagtgcctatggcatgacctgggtccggccgggctccaggaggggactggagtgggtctcaagtatcggagctggtggtgtcactttctacggagactccgtgaagggccgcttcaccattccagggacaattcgcaggacaaattgtttctccaatgaaaaacctgagacccgaggacacaggcgtctattactgtttgaaagccaggaccacggtgaccccccatgacacctttagtacttggggccgggggacagtgtgaccgtctcttcagcctccaccaaggcccatcgtcttccccctggcgccctgctccaggagcacctccgagagcacagcggccctgggctgcctggtcaaggaactacttcctatatactgtctgagcgggctggcaaggcgcatag

SEQ ID NO: 792467 - DNA, 704 bp, Homo sapiens
  misc_feature: 52582.UNK.UNK.UNK.pb.heavy.1.raw 52582
cgtatcgcctccctcgccgccatcagacagtatataccacgaccggtgctcgatttagcactcgcaacgtttgggttttggggagaggagccagcactgggattccgaggtgtttccattcggtgatcagcactgaaacacagagactcaaccatggagttttggctgagctgggttctccttgttggactttttaaaaaggtgtccagtgtgaggtgcggctgatggagtctggaggaggctttagtccagcctggggggtccagagactctcctgtgcagcctctgggctcaccgtcagcagcaaactacatgagttgggtccgccaggctccagggaaggggctggaagtgggtctcagtcatttatactggtgatttcacatactacgcagactccgtgaagggccgatttcaccatctccagggacaattccaggaacacggtttatcttcaaatgaacaacctgagaggcgacgacacgggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcaacctctgggggcacagcggccctggctgcctgggtcaaggactacttcctatatactgtctgaaagccggggc

SEQ ID NO: 792468 - DNA, 555 bp, Homo sapiens
  misc_feature: 52587.44.38.D05.1.pb.heavy.1.raw 52587
ctatgcgccttgccagcccgctcagacagtatataggggagtagtccttgaccaggcagcccagggccgctgtgcccccagaggtgctcctgggagcagggcgccaggggaagacgatgggcacttggtggaagctgaagggacgctgacccgtggtcccttggccccagacgtccataccgttgagtagtagtatgcaactccccgaacccgacccggctcttgcacagtaatacacagccgttgtcctcggctctcaggactggttcatttgcagatacagcgtgttcttggcgttgtctctggagatggtgaatcgggcccttcacggagtcccggtagcttgtgctactcccatcactattaatacgtgagaccccacacccagccccttccctggagcttggccggaccccagtgcatccagtagctactgaaggtggaatccagaggctgcacagggaggagtctcaggacccccaggctgaactatcagatactaaatcgagcaccggtcgtgtatatactgtctgatggcgcgagggaggcgatacg

SEQ ID NO: 792469 - DNA, 709 bp, Homo sapiens
  misc_feature: 52595.UNK.UNK.UNK.pb.heavy.1.raw 52595
ctatgcgccttgccagcccgctcagacagtatataggaagtagtccttgaccaggcagcccagggccgctgtgcccccagaggtgctctttgagaggagggtgccagggggaagaccgatgggcccttggtggaggcggaggcgacggtgaccaggggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggcctgcacaggagagtctcttgggaccccccaggctggactaagcctcctccagactccatcagccgcacctcacactggacaccttttaaaagtccaacaaggagaacccagctcagccaaaactccatgtgagtcctctgtgttcagtgctgatcagccgaatggaaacacctcggaatcccagtgctgggctcctctccccccaaacccaacgtgcgagtgctaaatcgagcaccggtgtgtatatactgtctgatggcgcgagggaggcgatacg

SEQ ID NO: 792470 - DNA, 696 bp, Homo sapiens
  misc_feature: 52672.44.55.E11.1.pb.heavy.1.raw 52672
ctatgcgccttgccagcccgctcagacagtatataggaagtagtccttgaccaggcagcccaggccgctgtgccccagaggtgctctggaggagggtgccagggggaagaccgatgggcccttggtggaggcgaggcgacggtgaccaggggttccctggccccagaagtcaaacgaataataaccactccgagcgccgactgtctcgcacagtaatagacggccgtgtcgctctcaggttgttcattttgaagataaaacgtgttcctggaattgtccctggagatggtgaacggcccttcacggagtctgcgtagtatgtgaaatcacagtataaatgactgagaccactccagccccttccctggagcctggcggacccaactcatgtagttgctgctgacggtgagcccagaggctgcacaggagagtctctgggaccccccaggctggactaagcctcctccagactccatcagccgcacctcacactggacacctttttaaagtccaacaaggagaaacccagctcagccaaaactccatggtgagtcctctgtgttcagtgctgatcaccgaatggaaacacctcgaatcccagtgctgggctcctctcccccccaaacccaacgtgcgagtgctaaatcgagcaccggtcgtgtatatactgtctgatggcgcgagggaggcgatacg

SEQ ID NO: 792471 - DNA, 709 bp, Homo sapiens
  misc_feature: 52710.44.55.E11.1.pb.heavy.1.raw 52710
cgtatcgcctccctcgcgccatcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagttctggaggaggcttagtccagcctggggggtcccagagactctcctgtgcagcctctgggctcaccgtcagcagcaactacatgagttgggtcccgccaggctccagggaaggggctggagtgggtctccagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792472 - DNA, 710 bp, Homo sapiens
  misc_feature: 52771.UNK.UNK.UNK.pb.heavy.1.raw 52771
cgtatcgcctccctcgcgccatcagacagtatatacacgaccgggtgctcgatttagctgcgtcacgatctctcttgggagctctcagagaggtgccttagccctggattccaaggcatttccacttggtgatcagcactgaacacagaggactcaccatggagttggggctgcggctgggtttccttgttgctattttagaaggtgtccactgtgaggtgcggctggtggagtcctgggaggcttggtacagcgggggggtccctgagactctcctgtgcagcctctggattcatcttcagtgactatgccatgaactgggtccgccaggctccagggaagggctggagtggttcatatgttaatattgctggagataccacctactacgcagactctgtgaagggccgattcaccaattccagggacaatgccaagaactcactgtatctggaaatgaacagcctgagagacgaggacacggctgtctacttctctgttcgagagatcgggccacttggtcagtggctggttttgactactggggccggggaaccctggtcaccgtctcctcaggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792473 - DNA, 692 bp, Homo sapiens
  misc_feature: 52774.UNK.UNK.UNK.pb.heavy.1.raw 52774
ctatgcgcccttgccagccgctcagacagtatataggaagtagtccttgaccagcccagccagggccgctgtggctctcggaggtgctcctggagcagggcgcccagggggaagaccgatgggccttggtggaggcggagagacggtgacaggtccctgggccaggcgtcgaatgaacgatttggaaacagatagtctcgcacaaaaatacacggccgtgtcctgaggctcaggctgttcatttgaagagacactgtgttctcggaattgtctctggagatggtgaatcggccctcaacggaatcaccgtagactttgatttcctccatgaaatgacacactgccacccactccagcccctcgcctggagcctggcggaccactgcatattccaattatcgaaggtgaatccagaggcctgcacaggagagtctcagggcccccctactgggccacgctccccagactccacgattgcacctgacacatgacacctcttaagagggcaacgaggaaacccagctcagcccaaactccatggtgagtctctgtggttcagtgatgatcaccgagtggaaacaccggcgacttcagtgctgggctcgtctcccagcccaaaccgcttcgatcgcgtctaaatcgagcacacggtcgtggtatatactgtctgatggcgcgagggaggcgatacg

SEQ ID NO: 792474 - DNA, 714 bp, Homo sapiens
  misc_feature: 52811.UNK.UNK.UNK.pb.heavy.1.raw 52811
cgtatcgcctccctcgcgccatcagacagtatatacacgaccgtgctcgatttagagtgaggctcgttggttgggagctctggagaggagcccagcaccagagtcggcggtgtttccagtcggtgatcagcaccgaacacagaggactcaccatggagtttgggctgacctggttttcctcgttgctcttttaagagagtgtccagtgtcaggtggaagctggtggagtctgggaggcgtggtccagcctgggaggtcctgagactctcctgtgtagccgtctgattcacttcaacagacatggcatcgcactgggtccgccaggctccaggcaagggactggagtgggtgcacttatatggtatgatggaagtaataaatattatgtagattccgtgaagggccgattcaccatctccagagacaattcgaagaacacactatatctggaaatgaatagcctgagagccgaggacacccggctgtctactactgtgcgaagatgggctcgtggatacagatatgacatgctctactcaatggtatggacgcctggccaaggaccacggtcgccgtctcctcagcctccaccaagggcccatcgtcttccccctggcacctcctccagagcacctctggggcacagcggccctgggctgcctggtcaggactacttccctatatactgtctgagcgggctggcaaggcgcatag

SEQ ID NO: 792475 - DNA, 709 bp, Homo sapiens
  misc_feature: 52821.44.36.D03.1.pb.heavy.1.raw 52821
cgtatcgcctccctcgcgccatcagacagtatatacacgaccggtgctcgatttagctgcgtcacgattctctctgggagctctcagagaggtgccttagccctggattccaaggcatttccacttggtgatcagcactgaacacagaggactcaccatggagttgggggctgcgctgggttttccttgttgctattttagaaggtgtccactgtgaggtgcgctggtggagtctgggggaggcttggtacagcgggggggtccctgagactctcctgtgcagcctctggattcatcttcagtgctatgccatgaactgggtccgccaggctccagggaaggggctggagtgggtttcatatgttaatattgctggagataccacctactacgcagacttctgtgaagggccgattcaccaatttccaggacaatgccaagaactcactgtatctggaaatgaacagcctgagagacgagacacggctgtctacttctgttcgagagatcgggccacttggtcagtggctggttttgactactggggccggggaaccctggtcaccgtctcctcagcctccaccaagggcccatcggttcttcccctggcgccctgctccaggagcactccgagagcacagcggccctgggctgcctggtcaaggactactcctatatacctgtctgagcgggctggcaaggcgcatag

SEQ ID NO: 792476 - DNA, 683 bp, Homo sapiens
  misc_feature: 52846.UNK.UNK.UNK.pb.heavy.1.raw 52846
ctatgcgccttgccagcccgctcagacagtatataggaagtagtccttgaccaggcagccaggccgctgtgctctcggaggtgctcctggagcagggcgccaggggaagaccgatgggccttggtgaggctgaggagacggtgaccagggttccctggcccccagtagtcaagcgggaccgtctcgagggggctctcgcacaataatagacagccgtgtcctcacttgtgaggttgtacatttgcagatgcagtgtgttcctggaattgtctctggagacggtgaatcggccttctcggagtctccgtagtgttcttcaattccatcttctgatataattgccacccactccagccccttgcctggagcctggcggaccagtgcatggcataggtcctgagatgaatccagaggctgcacaggagagtctcagggagttcccaggctgggccgctcctccccagactccactagctgcacctgacactggcccacctcttaaaagagcaacgaggaaaaccatctcagcccaaagtccatggtgagtcctctgtgttcagtgatgatcaccgaatggaaacaccggcgacttccagtgctgggctcgtctccccccctgagcgtagagctaaatcgagcaccgtcgtgtatatactgtctgatggcgcgagggaggcgatacg

SEQ ID NO: 792477 - DNA, 652 bp, Homo sapiens
  misc_feature: 52850.44.23.C01.1.pb.heavy.1.raw 52850
ctatgcgcgctgccagcccgctcagacagtatataggaagtagtccttgaccaggcagcccagggccgctgtgcccccagaggtgctcctggagcagggcgccagggggaaagccgatgggcccttggtggaagctgaggagacagtgaccagggtgccacggccccatagattgaaagaccagttcgcctcgcacagaaataaacggccgtgtccgcggcggtcacggaaggtcagttttcagggagaagcggttcatggacgtgtccctcgaaatggtgagacgactcttgaggacggagagtagtacgtcgccccagtataatggatgtcaccaatccactccattcccctccctgggggctgccgatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcaatgttctgcacaggaggtccttgactctcagaaagcccccaatccctaatcacgtgtactaaatcgagcaccggtcgtgtatatactgtctgatggcgcgagggaggcgatacg

SEQ ID NO: 792478 - DNA, 700 bp, Homo sapiens
  misc_feature: 52856.44.36.D03.1.pb.heavy.1.raw 52856
cgtatcgccttcctcgcgccatcagacagtatatacacgaccggtgctcgatttagctgcgtcacgatctctcttgggggagctctgagagcggagccccagcccagaattcccaggtgttttcatttggtgatcagcactgaacacagaggactcaccatggagttcgggctgagctgggtttttccttgttgttatttacaaggtgtccagagtgaagtgcagttggtggagtcgggggagacttggtccagcctggagggtccctgagactctcctgtgtcgccctctggattcaccatcagtgaccactatatggactgggtccgccaggctccagggaaggggctggagtgcttggccgcagtaaaaaaacaaagttgccagcttatcacagagtacgccgcgtctgtgaagccagattcaccctctcaagagatgacttcaagaactcattgattctgcgaatgactaacctgaaaaccgaggacacggcatgtattattgtgttgtgtttatatcaggaactgtccactggggcagggaaccctggtcaccgtctcctcagcctccacaagggcccatcgtcttcgcccctggcgccctgctccaggagcacctcccgagagcacagcggccctgggctgcctggtcaaggactacttcctatatacttctgagcggctggcaaggcgcatag

SEQ ID NO: 792479 - DNA, 704 bp, Homo sapiens
  misc_feature: 52866.44.27.C05.1.pb.heavy.1.raw 52866
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggaccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccgggcgacttccagtgctgggctcgtctcccagccccaaacccttcgatcgcgtctaaatcgagcaccggtcgtgtatatactgtctgatggcgcgagggaggcgatacg

SEQ ID NO: 792480 - DNA, 714 bp, Homo sapiens
  misc_feature: 52878.44.27.C05.1.pb.heavy.1.raw 52878
cgtatcgcctccctcgcgcccatcagtctatactatcacgaccggtgctcgatttagacgcgatcgaagggtttgggggccctgggagacgaggcccagcactgaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagggtaggcgggtccctgagactctcctgtgcagcctctggattcaccttcgataattggaatatgcagtggggtccgccaggctccaggcgaggggctggagtgggtggcaggtgtgtcatttcatggaggaaatcaagtctacggtgattcgttgagggccgattcaccatctccagagacaattccgagaacacagtgtctcttcaaatgaacagcctgagaccctcaggacacggccgtgtatttttgtgcgagactatctgtttccaaaatcggttcattcgacgcctggggccagggaaccctggtcaccgtctcctcggcctccaccaagggcccatcgggtcttccccctggcgccctgctccaggagcacctccgagagcacagcggccctggctgcctggtcaaggactactctcctatatactgtctgagcggggctggccaaggcgcatag

SEQ ID NO: 792481 - DNA, 502 bp, Homo sapiens
  misc_feature: 52891.44.38.D05.1.pb.heavy.1.raw 52891
cgtatcgcctccctcgcgccatcagacagtatatacacgaccggtgctcgatttagtatctgatagttcagcctggggggtcctgagactctcctgtgcagcctctggattcaccttcagtagctactggatgcactgggtccgccagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccgtgcgggagttcgggagttgcatactactactacgtatggacgtctgggccaagggaccacggtcaccgtctcctcagcttccaccaagggccatcggtcttcccctggcgccctgctccaggagcacctctggggcacagcggccctgggctgcctggtcaaggactacttccta

SEQ ID NO: 792482 - DNA, 714 bp, Homo sapiens
  misc_feature: 52934.44.62.F07.1.pb.heavy.1.raw 52934
cgtatcgcctcctcggcgccatcagacagtatatacacgaccggtgctcgatttagtagtcgcataaagggaaagggagctctgagagaggagcccagccctgggattttcaggtgtcttcatttggtgaccaggaccgaacagagagaagtctccatggagtttgggctgaggctgccttttcttgtggcttttttaagggtgtcgtgtgtgaagtgcagttgttggagtctgggggggggcctgattcggcctgggaggtccctgaccctctctgtgcggcctctggattcacctttagtggcctatggcatgacctgggtccgccgggctccagggaggggactggagtgggtctcaagtatcggagctggtggtgtcactttctacggagactccgtgaaggccgcttcaccatttccagggacaattcgcaggacaaattgttttctccaaatgaaaaacctgagacccgaggacacaggcgtctattactgtttgaaagccaggaaccacggtgacccccccatgacacctttagtacttggggccgggggacagtggtgaccgtctcttcagcctccaccaagggcccatcggtcttcccctggcgccctgctccaggagcacctccgagagcacagcggccctggggctgcctggtcaagggactacttcctatatactgtctgagcgggctggcaaggcgcatag

SEQ ID NO: 792483 - DNA, 700 bp, Homo sapiens
  misc_feature: 52943.44.36.D03.1.pb.heavy.1.raw 52943
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacactgggaattctggggctggggctccgctctcagagctccccaagagagatcgtgacgcagctaaatcgagcaccggtcgtgtatatactgtctgatggcgcgagggaggcgatacg

SEQ ID NO: 792484 - DNA, 692 bp, Homo sapiens
  misc_feature: 52944.44.74.G08.1.pb.heavy.1.raw 52944
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792485 - DNA, 698 bp, Homo sapiens
  misc_feature: 52945.UNK.UNK.UNK.pb.heavy.1.raw 52945
ctatgcgccttgccagcccgctcagacagtatataggaagtagtccttgaccaggcagcccagggccgctgtgctctcggaggtgctcctggagcagggcgccagggggaagaccgatgggcccttgtggaggctgaggagacggtgaccagggttccctggccccagtggacagttcctgatataaacacaacacaataatacatgcccgtgtcctcggttttcaggttagtcattcgcagaatcaatgagttcttgaagtcatctctgagagggtgaatctggctttcacagacgcggcgtactctgtgataaagctggcaactttgtttttactgcggccaagccactccagccccttccctggagcctggcggaccagtccatatagtggtcactgatggtgaatccagaggcgacacaggagagtctcagggaccctccaggctggaccaagtctcccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccgtcgtgtatatactgtctgatggcgcgagggaggcgatacg

SEQ ID NO: 792486 - DNA, 709 bp, Homo sapiens
  misc_feature: 52958.UNK.UNK.UNK.pb.heavy.1.raw 52958
cgtatcgcctccctcgcgccatcagaccagtatatacacgacccgtgtgctcgattagtgagtcacgtaaagggaaaggggctgggagaggagcaagcactagaagtggcggtgtttccattcgtgatcagcactgaacaacagaggactcccaccatggagtttgggctgagctgggttttccttgtttgctctttaagaggtgtcagtgtccgtgcaggttcgcctggtggagtctggggggggggcagttcgctggtccagctggtgacggtggtccgcctggacgtcctgagactctcctgtgttgcgtccggactcagtttcagtgactctgccatgcactgggtgcgccagctccaggcaaggggctggaggtgggtggcagtcatctggtctgatggaagtaaagaatactatggaaactccgtgaaggccgattctccgtctccagagacaattccaagaacacccgtgtatctacaaatgaacaatttgagagcccgaggactcgggctctctattattgtacgagcccatcgttcttactgggccagggagccctggtcaccgtctcctcagcctccaccaaggcccatcggtctccctgggccctgctccaggagcacctccgagagcacagcggccctggactgcctggtcaagactacttcctatatactgtctgagcgggctggcaggcgcatag

SEQ ID NO: 792487 - DNA, 548 bp, Homo sapiens
  misc_feature: 53022.44.43.D10.1.pb.heavy.1.raw 53022
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcgggggaggtggttcgacccctggggccagggaaccctggtcaccgtctcctcagcttccaccaagggccatcgtcttcccctggcgccctgctccaggagcacctctgggggcacagcggccctgggctgcctggtcaaggactacttcctatatactgtctgagcgggctggcaaggcgcatag

SEQ ID NO: 792488 - DNA, 668 bp, Homo sapiens
  misc_feature: 53044.44.67.G01.1.pb.heavy.1.raw 53044
cgttcgccctccctcgcgcatcagacgtatatacacgaccggtgctcgattagagtatacatattggtttgggggggagaggagcccagcactgggattccgaggtgtttccattcggtgatcagactgaaacagagactcaccatgagttttgctgagctgggttccttgttggcttttaaaagggtccagtgtgaggtgcggctgatgagtctggaggaggcttagtccagccggggggctccagagactctcctgtgcagcctctgggctcaccgtcagcagcaactcatgagttgggtccgcaggctcaggaaggggctggagtgggtctcagtcatttatactggtgatttcacatactacgcagactccgtgaagggcgattcaccatctcagggacaattccaggaacacggtttacttcatgcaactggaggcgacgacacggcgtctattactgtgcgagacaagtcggcgctcggagtgttattattcgtttgacttctgggccaggaccctggtcaccgtcgcctccgcctccaccaagggccatcggtcttcccccctggcacctcctcaagagcacctctgggggcacagcgccctgggctgcctggtcaaggactacttcctatatactgtctgagcggctgcaaggcgcatag

SEQ ID NO: 792489 - DNA, 590 bp, Homo sapiens
  misc_feature: 53076.UNK.UNK.UNK.pb.heavy.1.raw 53076
gaaggctggcaggctatgcaccctggtccaggtcaaaagctgcggaacccgctgcgcatctggccactaggggtcccgcagattcatttgtcgtctagcatgcacaatgctgcaacccagcttgcaatgcccacagcaagcggccaatctttacgccacgttgaattgtttatacctgtgactggctatgcttgcaacgccactcgtaaaactaagtactttgcggttaggggaagtagacaaacccattacttccactcccggaagttcaactcattccaacacgaaataaaagtaaactcaacacccaagcaggctatgtggggggtgataggggtggattctatttcctatcccatccctagatctccataagttacttagcgagttaaatgtctgtgcgatcccgtcagtctatcgcgcgcatcaagacctggttggttgagcgtgcagtagatcatcgataagctgcgagttaggtcatcccgaccgcatctggcgcctaaacgttcagtggtagctagcgtcaccttcgactggtctaaaggcaattgtcgtccttagctccaagtccctagcagcgtgtcggg

SEQ ID NO: 792490 - DNA, 715 bp, Homo sapiens
  misc_feature: 53096.44.36.D03.1.pb.heavy.1.raw 53096
cgtatcgcctcccctcgcgccatcagacaccgtatatacacgaccggtgctcgatttagctgcgtcacgaatctctcttgggagctctgagagcgagccccagcccccagaattcccagggtgttttcatttggtgatcagccactgaacacagaggactcaccatggagttgcggcctgagctgggttttcttgttgttattttacaaggtgtccagagtgaagtgcagttggtggagtccggggagacttggtccagcctggagggtccctgagactctcctgtgtcgcctctggattcaccatcagtgaccactatatgcgactgggtccgccaggctccagggaaggggctggagtggcttggccgcagtaaaaacaaagttgccagctttatcacagagtacgccgcgtctgtgaaagccagattcaccctctcaagagatgactttcaagaactcattgattctgcgaatgactaacctgaaaaccgaggacacgggcatgtattattgtgttgtgtttatatcaggaactgtccactggggccagggaccctggtcaccgtctcctcagccttcgccacgcaagggcccatccgtcttccccctggcgccctgctccaggagcacctccgagaagcacagcgcctgggctgcctggtcaaggactacttcctaatatactggtctgagcggctggcaaggcggcatag

SEQ ID NO: 792491 - DNA, 604 bp, Homo sapiens
  misc_feature: 53112.UNK.UNK.UNK.pb.heavy.1.raw 53112
gaaggctgggcaggctatgcaccctggtccaggtcaaaagcctgcggaacccgctagcggccatcttggccactagggtcccgcagattcatattgtcgtctagcatgcacaatgctgcaaacccagcttgcaatgccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaaataaaagtaaactcaacacccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtgctaaggcgtcaccttcgactgtctaaaggcaatatgtcgtccttagctccaagtccctagcaagcgtggcgg

SEQ ID NO: 792492 - DNA, 696 bp, Homo sapiens
  misc_feature: 53137.44.67.G01.1.pb.heavy.1.raw 53137
cgtatcgcctccctcgcgccatcagacagtatatacacgaccggtgctcgatttagagtatacatattgggtttggggggagagagcccagcactgggattccgagtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtgttattattcgtttgacttctggggccagggaaccctggtcaccgtcgcctccgcctccaccaagggccatcggtcttccccctggcaccctcctcaagagcacctctgggggcacagcggccctggctgcctggtcaaggactacttcctatatactgtctgagcgggctggcaaggcgcatag

SEQ ID NO: 792493 - DNA, 709 bp, Homo sapiens
  misc_feature: 53147.44.6.A06.1.pb.heavy.1.raw 53147
ctatgcgccttgcccagccgctcagacagtatataggaagtagtccttgaccaggcagcccaggggccgctggtggccccccagaaggtgctcctggagcagggcgccagggggaagaccgatggggccctttggtggaagctgaggtgacaatgaccagggttccctgcccccagaatctcaaagggctccatgcgagcttgggggtacggacctctcgcacagtagtagacgggccgtgtcgtcggatttcaaagaactcattgtcatggagactgtgtctgtggacttgtccgcggtaatcgtaatttctgcccccggaaggtcctcgtgcgtaggtgagtgagccaaaaagaggggatgattccacccatcccactcaagccccttgtccaggggcctgggcgcacccagttgatggtaataagtagtggaaactggtagtacttccagaggccgtgcaggaaagggtcaccgaggaccaaaggtttgcgggcattctagtcccagactgcaaccagttgcacagggactggacacctgtttgctgcttgccaccacaaagaggaaaccttccagggtccaagtccatggtgatgagctgtgctttcccaggggcttcttttagaggaggaatgtggttgtcagtagatctaaatcgagcaccggtcgtgtatatactgtctgatggcgcgagggaggcgatacg

SEQ ID NO: 792494 - DNA, 728 bp, Homo sapiens
  misc_feature: 53152.44.86.H09.1.pb.heavy.1.raw 53152
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccctttgcctggagcctggcggacccagtgcatgccatgtctgttgaaggtgaatccagacgctacacaggagagtctcagggacctcccaggctggaccacgcctccccccagactccaccagctctcacctgacactggacacctcttaaagagcaacgaggaaacccaggtcagcccaaactccatggtgagtcctctgtgttcggtgctgatcaccgactggaaacaccgccgacttctggtgctgggctcctctcccagagctccccaacccaagtctatagcactaatcgagcaccggtcgtgtatatactgtctgatggcgcgagggagcgatacg

SEQ ID NO: 792495 - DNA, 613 bp, Homo sapiens
  misc_feature: 53153.44.23.C01.1.pb.heavy.1.raw 53153
cgtatcgcctcctcgcgccatcagacagtatatacacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggaggggaatggagtggatggtgacatccattatactggggcgacgtactactctccgtccctcaagagtcgtctcaccatttcgagggacacgtccatgaaccgcttctccctgaaactgacctccgtgaccgccgcggacacggccgttattctgtgcgaggcgagactggtctttcaatctatggggccgtggcaccctgtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792496 - DNA, 706 bp, Homo sapiens
  misc_feature: 53157.44.36.D03.1.pb.heavy.1.raw 53157
ctatgcgccttgccagcgccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtcacagggaccctccaggctggaccaagtctcccccggactccaccaactgcacttcactctggacaccttgtaaaataacaacaaggaaaacccagctcagcccgaactccatggtgagtcctctgtgttcagtgctgatcaccaatgaaaacacctgggaattctggggctgggctccgctctcagagctccccaagagagatcgtgacgcagctaaatcgagcaccggtcgtgtatatactgtctgatggcgcgagagggaggcgatacg

SEQ ID NO: 792497 - DNA, 720 bp, Homo sapiens
  misc_feature: 53174.44.33.C11.1.pb.heavy.1.raw 53174
ctatgcgccttgccagccgctcagacagtatataggaagtagtccttgaccaggcagcccagggccgctgtgcccccagaggtgctcttggaggaggtgccagggggaagaccgatgggcccttggtggaggctgaggagacggcgaccgtgggtccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggccttcacggaatctacataatatttattacttccatcataccatataagtgccacccactccagtcccttgcctggagcctggcggacccagtgcatgccatgtctgttgaaggtgaatccagacgctacacaggagagtctcaggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagccccaaaccaacgagctcactctaaatcgagcaccggtcgtgtatatactgtctgatggcgcgagggaggcgatacg

SEQ ID NO: 792498 - DNA, 766 bp, Homo sapiens
  misc_feature: 53178.44.33.C11.1.pb.heavy.1.raw 53178
ctatgcgccttgccagcccgctcgaccagtatataggaagtagtccttgaccaggcagccccagggccgctgtgcccccagaggtgctcttggaggagggtgccagggggaagaccgatggggcccttggtggaggctgaggaagacggcgaccgtggtcccttggccccaggcgcgtccataccattggagtaggagcatgtcatatctgtatccacgaggccccatctctcgcacagtagtagacagccgtgtcctccggctctcaggctattcatttccagatatagtgtgttcttcgaattgtctctggagatggtgaatcggtccttcacggaatctacataatatttattacttccattcataccatataagtgccacccactccagtcccttgctggagcctggcggaacccagtgcatgccatgtctgttgaaggtgaaatccagacgctccggagatcacaggacctgccagggtctcaggactcctcccaggctggacacgcctcccccagactccaccagcttcacctgacactggacacctcttaaaaagcaacgaggaaaacccaggtcagcccaaactccatggtgagtcctctggtgtcggttcggtgctgatcaccgactggaaacaccgcgcgacttctggtgctggggcttcctctccagagctccccaaactccaacgagctcactctaaatcgagcaccggtcgtgtaatactcccactgtctgatggcgcgagggaggcgatacg

SEQ ID NO: 792499 - DNA, 683 bp, Homo sapiens
  misc_feature: 53182.UNK.UNK.UNK.pb.heavy.1.raw 53182
cgtatcgcctccctcgcgccatcagacagtatatacacgacggtgctcgatttagtgtcgtcgcaagagagaggagccccagccgtgagattcccaggagtttccacttggtgatcagcactgagcacagacaccaaccatggagtttgggctaatcttgattttccttgtagtttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggctgagtggatcacttcgtcagaatgaaacgttatggtggaagtaaagagtacgccgcgtctgtgaagggaagattcaccgtctcaagggatgactccaacagtgtggccatttacaaatgagcaacctgagacccgacgacacaggcgtctattactgcgccaggcgatcctgggacgtcgatgcatttgatatttgggccaggggacaatggtcacgtctcttcagcttccaccagggccatcggtcttcccctggcgccctgctccaggagcactctgggggcacagcggccctgggctgcctggtcaaggactacttcctatatactgtctgagcgggctggcaaggcgcatag

SEQ ID NO: 792500 - DNA, 708 bp, Homo sapiens
  misc_feature: 53192.44.84.H07.1.pb.heavy.1.raw 53192
ctatgcgccttgccagcccgctcagacagtatataggaagtagtccttgaccaggcagcccagggccgctgtgcccccagaggtgctcttggaggagggtgccagggggaagaccgatgggcccttggtggaggctgcggcgacggtgaccagggctccctggccccaggagttgaaccacccacccactgtggatccagtcccccccctcttcgcacagaaataaagggccgtgtcttcgactctcaggctgttcatttccagaaaaagtgtgttccggaattgtctctggagatggtgaagcggcccttcacggactctccgtagtatgtgtcagttgcactagcgccaattgtcgagacccactcgagccccttccctggagcctggcggacccaggtcatggcatagctcctaaagggaagccagaggctgcacaggagagtctcagggacccccaggctgtgccaatcctcccagactccaacagggccacctcacactggacaccttttaaatagtcacaagaaaaagccacctcagcccaaactccatggtgagttctctctgttcagtcctgatcaccaaatgaaaacacctgaaaatcccagggctgggctcctctctcagagctccccgcgacagacgtctgctaaatcgagcaccggtcgtgtatatactgtctgatggcgcgagggaggcgatacg

SEQ ID NO: 792501 - DNA, 666 bp, Homo sapiens
  misc_feature: 53208.44.53.E09.1.pb.heavy.1.raw 53208
cgtatcgcctccctcgcgccatcagacagtatatacacgaccggtgctcgattttagagagagtgtgttgggtttggggggaagcacctgtggttcttcctcctgctggtggcggctcccagatgggtcctgtctcagcccgcagctgcgggagtcgggcccaggactggtgaagccttcggagacccctgtccctcacggtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactggtgtcagacatgggtccgcctatggcaggtcgtctcaattctacttacgcttgggacgtctggggccaagggacccacggtcaccgtctcctcatcctcagcctccaccaagggcccatcggtcttcccctggcgccctggctccaggagcacctccgagagcacagcggcccctgggctgcccctggtcaaggactacttcctatatactgtctgagcgggctggcaaggcgcatag

SEQ ID NO: 792502 - DNA, 701 bp, Homo sapiens
  misc_feature: 53212.44.78.H01.1.pb.heavy.1.raw 53212
ctatgcgcctttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgttcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcaggcaaggaaaatccagctcaggcccaaaactccatggtgagtcctctgtgttcagtcctgatcactgaatgaaaaacacctgggaatcccaaggctggggcttcctctcccagagctccccaaacccaaactactcacactaaatcgagcaccggtcgtgtatatactgtctgatggcgcgagggagggcgatacg

SEQ ID NO: 792503 - DNA, 696 bp, Homo sapiens
  misc_feature: 53228.UNK.UNK.UNK.pb.heavy.1.raw 53228
cgtatcgcctccctcgcgccatcagacagtatatacacgacggtggctcgatttagtgtgagtagtttgggtttggggagctctgggagaggagcccagccttgggattcccagggtgttttcattcagtgatcaggactgaacacagaggactcaccatggagtttgggctgagctggattttccttgctgctattttaaaaaggtgtccagtgtgaggtgcagttggtggagtctgggggaggtttggtaaagcctggggagtcccttagactctcctgtgcagcctctggattcacttcagtaacgcctggatgacctgggtccgccaggctccagggaagggctggagtggttggccgtattagaaccaaagctgacggtgggacagcagactacgctgccacccgtgaaaggcagattcaccatctcaaagagatgattcaaaagatacggtgtctctgcagatgaacagcctgaacaccgaggacacagccgtctattactgtctgggatggtttcattcgggccagggaaccctggtcaccgtctctcagcctccacaagggcccatcggtcttccccctggcgccctgctccaggaggcacctccgagagcacagcggccctgggcctggcctggtcaagggactacgttcctatatactgtctggagcgggctggcaaggcgcatag

SEQ ID NO: 792504 - DNA, 705 bp, Homo sapiens
  misc_feature: 53229.44.67.G01.1.pb.heavy.1.raw 53229
ctatgcgccttgccagcccgctcagacagtatataggaagtagtccttgaccaggcagcccagggccgctgtgcccccagaggtgctcttgaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaatatgtatactctaaatcgagcaccggtcgtgtatatactgtctgatggcgcgagggaggcgatacg

SEQ ID NO: 792505 - DNA, 721 bp, Homo sapiens
  misc_feature: 53237.44.85.H08.1.pb.heavy.1.raw 53237
ctatgcgccttgccagcccgctcagacagtatataggaagtagtccttgaccaggcagcccagggccgctgtgcccccagaggtgctcttggaggagggtgccaggggaagaccgatggccccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgccatagtttttattacttccatcataccatataagtgccaccactccagccccttgcctggagcctggcggacccagtgcatgccataggtactgaggtgaatccagacgctgcacaggagagtctcagggacctcccaggctggaccacgcctcccccagactccaccagctgcacctgacactggacacctcttaaagagcaacgaggaaaaacccagctcagcccaaactccatggtgagtcctctgtgttcagtgctgatcaccgaatggaaacaccgccgacttctagtgctgggctcctctccagagctcccgcgactgagtgatactaaatcgagcaccggtcgtggtatatactgtctcgatggcgcgagggaggcgatacg

SEQ ID NO: 792506 - DNA, 646 bp, Homo sapiens
  misc_feature: 53243.44.86.H09.1.pb.heavy.1.raw 53243
ctatgcgccttgccagcccgtcagacagtatataggaagtagtccttgaccaggcagccaggccgctgtgccccagaggtgctcctggagcaggcgccagggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtccaccaatccactccattcccctccctgggggctgccggatccagccccagaatgatcagaactgatggaaactccagagacagtgcagatgagagacagggttcccgaaggcctcaccagttcctgggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatgcgcgagggaggcgatacg

SEQ ID NO: 792507 - DNA, 681 bp, Homo sapiens
  misc_feature: 53255.44.45.E01.1.pb.heavy.1.raw 53255
ctatgcgccttgccagcccgctcagacagtatataggaagtagtccttgaccaggcagcccagggccgctgtgctctcggaggtgctcctggagcagggcgccagggggaaagaccgatggcccttggtggaggctgaggagacggtgaccagggctccctggcccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtggcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtctctgtgttcagtgctgatcaccgaatggaaacaccgccgacttctagtgctgggctcctctcccagccccttcccttactgactcactaaatcgagcaccggtcgtgtatatactgtctgatggcgcgagggaggcgatacg

SEQ ID NO: 792508 - DNA, 693 bp, Homo sapiens
  misc_feature: 53258.UNK.UNK.UNK.pb.heavy.1.raw 53258
ctatgcgccttgccagcccgctcagacagtatataggaagtagtccttgaccaggcagcccagggccgctgtgctctcggaggtgctcctggagcaggggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagaggacactgtgttctcggaattgtctctggagatggtgaatcggccctcaacggaatcaccgtagacttgatttcctccatgaaatgacacacctgccacccacctccagcccctcgcctggagcctggcggacccactgcatattccaattatcggaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttcctcttccccaaacccttcgatcgcgttctaaatcggagcaccggtcgtgtatatactgtctgatggcgcgaggggaggcgatacg

SEQ ID NO: 792509 - DNA, 696 bp, Homo sapiens
  misc_feature: 53268.44.27.C05.1.pb.heavy.1.raw 53268
ctatgcgccttgccagccgctcagacagtatataggaagtagtccttgaccaggcagcccagggccgctgtgctctcggaggtgctcctggagcagggcgccaggggaagaccgatgggcccttggtggaggcgaggagacggtgaccagggttcctggccccaggcgtcgaatgaaccgattttggaaacagatagtctcgcacaaaaatacacggccgtgtcctgaggtctcaggctgttcatttgaagagacactgtgttctcggattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggaccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtataactgtctgatggcgcgagggaggcgatacg

SEQ ID NO: 792510 - DNA, 693 bp, Homo sapiens
  misc_feature: 53273.44.74.G08.1.pb.heavy.1.raw 53273
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgccgtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccggaggaccaaggttgcggcattctagtcccagactgcaccagtttgcaccagggactggacacctgttgctgctgccaccacaaagaggaacctccaggtccagtccatggtgatgagcctgtgctccaggggcttcttagaggaggaatgtggttgttatgtgatgctccccctgatagagctactaaatcgagcaccggtcgtgtatatactgtctgatggcgcgagggaggcgata

SEQ ID NO: 792511 - DNA, 685 bp, Homo sapiens
  misc_feature: 53440.UNK.UNK.UNK.pb.heavy.1.raw 53440
cgtatcgctccctcgcgccatccagacagtatatacacgacgtgctcgattgcactcgcacgttggtttggggcgggagagagcccagcactgattccgagtgttccattcgggggatcagcactgaacacagaggactcaccatggagtttggctgagctgggttctccttgttggactttaaaaggtgtccagtgtgagtggcggctgatggagtctggagaggcttagtccagcctggcggctccagagactctcctgtgcagcctctggctcaccgtcagcagcaactacatgagttgggtccgccaggctccaggaaggggctggagtggctccagtcattctatactgggtgattcacatactacgcagactccggaaagggcgattcaccatctccagggacaattcaggaacaccggtttatctcaatgaacaacctgagaggcgaacgaccacggccgtgctattactgtgcagacaagtcggcgctcgagtggttattattcgtttgacttctgggccagggaacctggtcaccgtcgcctccgctccaccaggggcgccatcggtcttcccgtggcacctcctccaaaggcccctctggggcacagcggcctgggcctgcctggtcaaggactacttcctatatactgtctgagcgggctggcaaggcgcatag

SEQ ID NO: 792512 - DNA, 715 bp, Homo sapiens
  misc_feature: 53469.UNK.UNK.UNK.pb.heavy.1.raw 53469
cgtatcgcctccctcgcgccatcagacagtatatacacgaccggtgctccgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtcccgggggagactggtccagcctggagggtcctgagactctcctgtgtcgcctctggattccaccatcagtgaccactatatggactgggtccgccaggctccagggaagggggctggagtggcttggccgcagtaaaaacaaagttgccagctttatcacagagtacgccgcgtctgtggaaagcccagattcaccctctcaagagatgacttcaagaactcattgattctgcgaatgactaacctgaaaaccggaggacacgggcatgtattattgtgttggtgtttatatcaggaactgtccactgggccagggaaccctggtcaccggtctcctcagcctccaccaagggcccatccggtcttccccctggcgccctggctccaggagcacctccggagaggcacagcggccctgggcctgcctggtcaaggactacttcctataactgtctgagcgggctggcaaggcgcatag

SEQ ID NO: 792513 - DNA, 649 bp, Homo sapiens
  misc_feature: 53470.44.23.C01.1.pb.heavy.1.raw 53470
ctatgcgccttgccagcccgctcagacagtatataggaagtagtccttgaccaggcagcccagggccgctgtgcccccagaggtgctcctggagcagggcgccaggggaagaccgatgggccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccacagcaggaggaaaaaccacaggtgcttcatgttcttgcacaggaggtccttgactctcagaaagcccccaatccctaatcacgtgtactaaatcgagcaccggtcgtgtatatactgtctgatggcgcgaggaggcgatacg

SEQ ID NO: 792514 - DNA, 693 bp, Homo sapiens
  misc_feature: 53482.UNK.UNK.UNK.pb.heavy.1.raw 53482
cgtatcgcctcctcgcgccatcagacagtatatacacgaccggtgctcgattttgatcacataacaaccacactcctcctctaaagaagcccctgggagcacagctccatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaaccttcttcagctatgcttttatttggtgcgacaggccctggacaagggcttgagtggctgggagggatcatccctatctttggtgcatcgaattacgcacagaagtttcaggacagagtcaccattaccgcggacgaatccacgagtacagcctacatggagctgagcaggctgagaatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792515 - DNA, 706 bp, Homo sapiens
  misc_feature: 53505.44.56.F01.1.pb.heavy.1.raw 53505
cgtatcgcctccctcgcgccatcagacagtatatacacgaccggtgctcgatttagcagacgtctgaacacacaaaggggagctctggagaggagccccagccgtgagattcccaggagtttccactggtgatcagcactgagcacagaccaccaaccatggagtttgggctaatcttgattttccttgtagtttttttagaaggtgtccagtgcgaggggcgactggcggagtcgggggggggcttggcacagcagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcacgtctcaagggatgactccaacagtgttggccatttacaaatgagcaacctgagacccgacgacacaggcgtctattactgcgccaggcgatcctgggacgtcgatgcatttgatatttgggccaggggacaatggtcaccgtctctctcagcttcaccaaggcccatcggtcttcccctggcgccctgctccaggagcacctctggggcacagcggccctgggctgcctggtcaaggactacttcctatatactgtctgagcggctggccaggcgcatag

SEQ ID NO: 792516 - DNA, 666 bp, Homo sapiens
  misc_feature: 53513.UNK.UNK.UNK.pb.heavy.1.raw 53513
ctatgcgccttgccagccccgctcagacagtatataggaagtagtccttgaccaggcagcccaggccgctgtgccccagaggtgctcctggagcagggcgccagggggaagaccgatggccttggtggagctgaggagacggtgaccgtggtcccttggcccccagacgtccataccgtagtagtagtatcgcaactcccgaactcccgcaccggctcttgcacagtaatacacagccgtgtcctcggctctcagactgttcattgcagatacagcgtgttctggcgttgtctctggagatggtgaatcggcccttcacggagtccgcgtgcttgtgctactcccatcactattaatacgtgagaccccacaccagcccctttccctggagcttggcggacccagtgcatcagtagctactgaaggtgaatccagaggctgcacaggagagtctcagggaccccccaggctgaactaagcctcccatgcccacgggtgcccagagcccaaatcttgtgacacacctcccccgtgcccaaggtgcccagcacctgaaactcctgggaggaccgtcagtcttctcttccgcccccaaacccactatcagatactaaacgagcaccggtcgtgtatatactgtctgatggccgcgagggaggcgatacg

SEQ ID NO: 792517 - DNA, 711 bp, Homo sapiens
  misc_feature: 53531.44.55.E11.1.pb.heavy.1.raw 53531
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatacttacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaacccctggtcaccgtcgcctccgcctccaccaagggcccatcggtcttccccctggcaccctcctccaagaggcacctctgggggcacagcggccctgggctgcctggtcaaggactacttcctatatactgctgaagcggggctggcaaggcgcatag

SEQ ID NO: 792518 - DNA, 677 bp, Homo sapiens
  misc_feature: 53547.44.12.B01.1.pb.heavy.1.raw 53547
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgcctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggggcctggagtggattggggagtatctattatagtgggggagcacctactacaaccccgtcgcctcaagagtcgagtccaccatatcaggtagacacgtccaagaaccagttctccctgaagctgagctctgtgaccgccgcggacacggcccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttccctatatactgtcctgagcgggctggcaaggcgcatag

SEQ ID NO: 792519 - DNA, 722 bp, Homo sapiens
  misc_feature: 53571.44.56.F01.1.pb.heavy.1.raw 53571
cgtatcgcctccctcgcgccatcagacagtatataacacgaccggtgctcgatttagcagacgtctgaacacacaaaggggctgggagaggagccccagccgtgagattccccaggagtttccacttgggtgatcagcactgagcacagaccaccaaccatggagtttgggctaatcttgattttccttgtagttttttagaaggtgtccagtgcgagggggcggactggcggagtcggggggggcttggcacagccagggcggtctctgagactcttcctgtgtagtctcaggattcagtcttagtgattatcacttggcctttggtccgtcaggctccagggaaggggcttgagtggatcactttcgttcagaatgaaacgttatggtggaagtaaagagtacgccgcgtctgtgaagggaagattcaccgtctcaagggatgactccaacagtgttggccatttacaaatgagcaacctgagacccgacggacacaggcgtctatttactgcgccaggcgatcctgggacgttcgatgcatttgatatttgggccaggggacaatggtcaccgtctcttcagcttccaccaagggcccatcggtcttcccctggcgccctgctccaggagcaccctctgggggcacagcggccctgggctgcctggtcaaggactctacttcctatatactgtctgaagcgggctggcaaggcgcatag

SEQ ID NO: 792520 - DNA, 684 bp, Homo sapiens
  misc_feature: 53697.44.45.E01.1.pb.heavy.1.raw 53697
cgtatcgcctccctcgcgccatcagacagtatataccacgaccggtgctcgatttagtgagtcagtaagggaaaggggctgggagaggagcccagcactagaagtcggcggtgttttccattcggtgatcaagcactgaacacagaggactcaccatggagtttgggctgagctgggttttcctcgttgctcttttaaagaggtgtccagtgtcaggttcagctggtggagtctgggggaggcgtggtccagcctgggacgttcctgagactctcctgtgttgcgtccggactcagtttcagtgactctgccatgcactgggtccgccaggctccaggcaaggggctggagtgggtggcagtcatctggtctgatggaagtaaagatatactatggaaactccgtgaagggccattctccgtctccagagacaattccaagaacacgtgtatctacaaatgaacaatttgagagcgaggactcggctctctattattgtacggcccatccgttctactgggcagggagcctggtcaccgtctcctcagcctccaccaagggcccatcggttcttccccctggcgccctgctccaggagcacctcgagagcacagcggccctgggctgcctgtcaaggaactacttcctaatatactgtcctgagcgggctggcaaggcgcatag

SEQ ID NO: 792521 - DNA, 666 bp, Homo sapiens
  misc_feature: 53726.44.12.B01.1.pb.heavy.1.raw 53726
gagagactgacagcgtatcgcctccctcgcgccatcagacagtatatacacgaccggtgctcgattagtagtgtagattccgcgggctttctgagagtcatggacctcctgtgcaagaacatgaagcacctgtggttcttcctcctgctggtggcggctcccagatgggtctgtccagctgcagctgcaggagtcgggcccaggactggtgaagccttcgagaccctgtccctcacctgcactgtctctggtggctccatcagcattagtagttactactgggctggatccgccgccccagggaagggcctggagtggatttgggagtatctattatagtgggaagcacctactacaacccgtccctcaagagtcgagtcaccatatcagtagacacgtccaagaaccagttctccctgaagctgagctctgtgaccgccgcggacacggccgtgtattactgtgcgagaagtagggcagttcgtcaccaactactttgaccactggggccaggaaccctggtcaccgtctcctcagcctccacaagggcccatcggtcttccctggcaccctcctcaagagcacctctggggcacagcggccctggctgcctggtcaaggactacttcctaatatactgtctgagcgggctggcaaggcgcatag

SEQ ID NO: 792522 - DNA, 594 bp, Homo sapiens
  misc_feature: 53783.44.36.D03.1.pb.heavy.1.raw 53783
cagcccgctcagacagtatataggaagtagtccttgaccaggcagcccagggccgctgtgcccccagaggtgctcctggagcagggcgccagggggaagaccgatgggcccttggtgggagctgaggagacggtgaccgtggtccctttgccccagacgtccagatggtaagacttataatacagaaaccagctgtttctttcccgcattacccgtgcaccagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacaccattctaatatcgttgagagagaacccagagatggtgcaggtcagcgtgagggtctctgtggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 792523 - DNA, 611 bp, Homo sapiens
  misc_feature: 53803.UNK.UNK.UNK.pb.heavy.1.raw 53803
cccgacacgcgcttgctagggacttggagctaaggacgaccatattgcctttagacagtcgaaggtgacgccttagctaccactgaacgtttaggcgccagatgcggtctgggatgacctactcgcagcttagtcgatgatctactgcacgctcaaccaaccaggtcttgatgcgcgcgataggctgacgggatcgctacagacatttaactcgctagtaacttaattgagatcctagggggatgggataggaaatagaatccacccctatcacccccccacatagcctgctttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatactgcgggacccctagtgccaagatggccgctagcgggttccgcagcttttgacctggaccagggtgcatagcctgcccagcctt

SEQ ID NO: 792524 - DNA, 684 bp, Homo sapiens
  misc_feature: 53810.44.45.E01.1.pb.heavy.1.raw 53810
cgtatcgcctccctcgcgccatcagaccagtatatacacgaccggtgctcgatttagtgagtcagtaagggaaaggggctgggagaggagcccagcactagaagtcggcggtgtttccattcggtgatcagcactgaacacagaggactccaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactgggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792525 - DNA, 608 bp, Homo sapiens
  misc_feature: 53832.UNK.UNK.UNK.pb.heavy.1.raw 53832
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaagtaaactcaacacccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792526 - DNA, 595 bp, Homo sapiens
  misc_feature: 53890.UNK.UNK.UNK.pb.heavy.1.raw 53890
gaaggctggcaggctatgcaccctggtccaggtcaaaagctgcggaacccgctagcgccatcttggccactagggtcccgcagattcatattgtcgtctagcatgcacaatgctgcaaacccgctgcaatgccacagcaagcggccaatctttacgccacgttgaattttttattacctgtgactgctatggcttgcaacgccactcgtaaaactagtacttgcggttaggggaagtagacaaaccattactccacttcccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcagcgtgtcgg

SEQ ID NO: 792527 - DNA, 700 bp, Homo sapiens
  misc_feature: 53904.44.55.E11.1.pb.heavy.1.raw 53904
ctatgcgccttgccagcccgctcagacagtatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggcgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccaaacccaacgtgcgagtgctaaatcgagcaccggtcgtgtatatactgtctgatggcgcgagggaggcgatacg

SEQ ID NO: 792528 - DNA, 663 bp, Homo sapiens
  misc_feature: 53908.44.12.B01.1.pb.heavy.1.raw 53908
ctatgcgccttgccagcccgctcagacagtatataggaagtagtcctttgaccaggcagcccagggccgcctgtgcccagaggtgctcttggagagggtgccaggggaagaccgatgggcccttggtggaggctgaggagacggtgaccagggttccctggccccagtggtcaagtagttggtgacgaactgccctactctcgcacagtaatacacggccgtgtccgcggcggtcacagagctcagcttcagggaagaaactggttcttggacgtgtctactgatatggtgactcgactcttgagggggacggtttgtagtaggtgctcccactataatagatactcccaatccactccagccccttccctggggctggcggatccagcccagtagtaactactactgctgatggagccaccagagacagtgcaggtgaggacaggggtctccgaaggcttcaaccagtcctggccccgactcctgcagctgcagctgggacaggacccatctggagccgcaccagcaggaggaagaaccacaggtgcttcatgttcttgcacaggaggtccatgactctcagaaagcccccgcggaatctacactactaaatcgagcaccggtcgtgtatatactgtctgatggcgcgaggagggcgatacg

SEQ ID NO: 792529 - DNA, 706 bp, Homo sapiens
  misc_feature: 53966.44.36.D03.1.pb.heavy.1.raw 53966
ctatgcgccttgccagcccgctcagacagtatataggaagtagtccttggaccaggcagcccagggccgctgtgctctcggaggtgctcctggagcagggcgcccagggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagtttcttgaagtcatctcttgagaggggtgaatctggctttcacagacgcggcgtactctgtgataaagctggcaactttgtttttactgccggccaagccactccagccccttccctgagcctggcggacccagtcgcatattagtggtcactgatggtgaatccagagggcgacacaggagagtctcagggaccctccaggctggaccaagtctcccccggactccaccaactgcacttcactctggacaccttgtaaaataaacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgcgagggaggcgatacg

SEQ ID NO: 792530 - DNA, 660 bp, Homo sapiens
  misc_feature: 54030.UNK.UNK.UNK.pb.heavy.1.raw 54030
cgtatcgcctccctcgcgccatcagacagtataacgaccggtgctcgatttagtagctctatcaggggagcatcacataacaaccacattcctctctaagaagccctgggagcacagctcatcacatggactgacctggaggttcctctttgtgggcagcgcaacagtgtcagtccctgtgcaactgtgcagtctgggactagaatgccgcaccttggtcctcggtgaccctttcctgcacggcctctggagtactaccagttccactacttataccatcactgggtggccaggcctggacaagggcttgagtggtgggtggaatcatccctctttgctcactcactacgcacgagacttcggggcagaattacgattaccccgcggaccagtccacagacacagtctccatgacaatgagttctttgatccgacgacacgccgtctactactgtgcgagaggtcgtaccccagctcgcatggagcctttgaaatctggggggcaggggaaccctggtcattgtcacctcagcttccaccaagggccatcggtcttccccctggcgccctgctccaggagcacctcggggcacagcggctggctgcctgggtcaggactactttccatatactgtctgagcgggctggcaaggcgcatag

SEQ ID NO: 792531 - DNA, 704 bp, Homo sapiens
  misc_feature: 54036.44.73.G07.1.pb.heavy.1.raw 54036
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatggcgcgagggaggcgatacg

SEQ ID NO: 792532 - DNA, 706 bp, Homo sapiens
  misc_feature: 54050.44.27.C05.1.pb.heavy.1.raw 54050
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggaagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagccctggcggaccactgcatattccaattatcgaaggtgaatccagaggctgccacaggagagtctcagggacccccctactggggccacgcctccccagactccacgaatttgcacctggacacatgacacctcttaagagggcaacgaggaaaaacccagctcagcccaaaactccatggtgagtcctctgtgttcagtgatgatcaccgagtggaaacaccggcgacttccagtgctgggctcgtctccagccccaaacccttcgatcgcgtctaaatcgagcaccggtcgtgtatatactgtctgatgcgcgagggaggcgatacg

SEQ ID NO: 792533 - DNA, 596 bp, Homo sapiens
  misc_feature: 54060.UNK.UNK.UNK.pb.heavy.1.raw 54060
cccgacacgcttgctagggacttggagctaagacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttattgagatcctaggggatgggataggaaatagaatcacccctatcacccccccacatagcctgcttggggtgttgagttacttttattcgtgttggaatgagtgaacttccgggaagtgagtaatgggtttgttacttcccctaaccgcaaagtactagtttaacgagtggcgttgcaagcctagccagtcacaggtaataaacaattcaacgtggcgtaaagattggccgcttgctgtgggcattgcaagctgggttgcagcattgtgcatgctagacgacaatatgaatctgcgggacccctagtggccaagatggccgctgcgggttccgcagcttttgacctggaccaggtgcatagcctgcccagccttc

SEQ ID NO: 792534 - DNA, 607 bp, Homo sapiens
  misc_feature: 54108.UNK.UNK.UNK.pb.heavy.1.raw 54108
cgtatcgctccctcgcgcgcgcatcagaacagtatatacacaggaccggtggctcgcgattagtattgatagctggggttttccttgtgctattttaaaggtgtccagtgtgaggtgcagctggtgagtccggggagctagtcagcctgggggtccctgagacctcctgtgcagcctctggattcaccttcagtagctaactggatgcactgggtccgccagctccaggaaggggctggtgtgggtctcacgtattaatagtgatgggagtagcacaagcacgcggactccgtgaagggccgattcaccatctccagagacacgccaagaacacgctgtatctgcaaatgaacagtctgaggagccgaggacacggctgtgtatactgttgcaagagcccggtgcggagttcggggttgcatactactactacggtatggacgtctgggccaagggaccacggtcaccgtcccctcagcttcaccaagggcccatcggtcttccccctggcgccctgctccaggagcacctctggggcacagcggccgggctgcctggtcaggactacttcctatatactgtctgaggcgggcgggcaggcgcatag

SEQ ID NO: 792535 - DNA, 706 bp, Homo sapiens
  misc_feature: 54111.44.70.G04.1.pb.heavy.1.raw 54111
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggtcccctggccccagtcatgcgcccggtaataactactaccacctcccgatctcgcacagtaatacagagccgagtcctcgactctcaggctgaccatttccaagtacacaatgttccgggaattgtctctggagatggtgaatcggcccttcacggagtctgcataatattcagaacttccatcatgtgctataactgccaaccactccggccccttgcctggagcctggcggacccagtgcatgccagaaccactgaaactaaatccagaggcttcacaggagagtctcagggacctcccaggctggaccacgcctcccccagactccaccaggtgcacctgacagtggacacctcttaaaagagcaacgaggaaaacccagctcagcccaaactccatggtgagtcctctgtgttcagtgctgatcaccgaatggaaacaccgcgacttctagtgctgggctcctctcccagacccctttcccttcacactacactaaatcgagcaccggtcgtgtatatactgtctgatggcgcgagggaggcgatacg

SEQ ID NO: 792536 - DNA, 654 bp, Homo sapiens
  misc_feature: 54127.UNK.UNK.UNK.pb.heavy.1.raw 54127
cgtatcgcctcccctcgcgccatcagacagtatataccagcgaccggggtgctcggatttaggtacacgcgatgtagggattggtggggcaggggtgaaccccggtgtgggtttttcctcctgctgggtggcagctcccagatgggtcctgtcccaggtgcagctgcaggagtcgggcccaggactggtgaggccttcgggggaaaccctgtctctcatctgcactgtctctggagtttccatcagttctgatcattcttggggctggatccggcagcccccagggaggggggaatggagtggattggtgacatccattatactgggggcggacgtactactctccgtccctcaagagtcgtctcaccatttccgagggacacgtccatgaaccgcttctccctgaaactgacccttccgtggaccgccgcggacacggccgtttatttctgtgcgaggcgagactggtctttcaatctatggggccgtggcaccctggtcactgttctcctcagcttccaccaaggggcccatcggtcttccccctggcgccctgctccaggagcaccctctggggggccacagtggccctgggctgcctggtcaaaggactacttcctatatactgttgagcgggctgggcaaggcgcatag

SEQ ID NO: 792537 - DNA, 672 bp, Homo sapiens
  misc_feature: 54141.44.23.C01.1.pb.heavy.1.raw 54141
ctatgcgccttgccagcccgctcagaccagtatataggaaagtagtccttgaccaggcagcccagggccgctgtgcccccagaggtgctcctggagcagggcgccaggggaaagaccgatgggcccttggtggaagctgaggagacagtgaccagggtgccacgggccccatagattgaaagaccagtctcgcctcgcacagaaataaacggccgtgtccgcggcggtcacggaggtcagtttcagggaagaagcgggttcatggacgtgtccctcgaaaatggtgagacgactcttgagggacggagagtagtacgtcgccccccagtataatggatgtcaccaatccactccattccccctcccctgggggctggccggattccagccccaagaatgattcagaaactgatggaaaactccagagacagtgcagatgagagaacagggtttcccgaaggcctcaccagtcctgggcccgaactcctgcagctgcacctggacaggaccccatctgggagctgccaccagcaggaggaaaaaccacaggtgcttcatgtttcttgcacaggaggtccttgactctcagaaagcccccaatccctaatcacgtgtactaaatcgagcaccggtcgtgtatatactgtctgatggcgcgagggaggcgatacg

SEQ ID NO: 792538 - DNA, 739 bp, Homo sapiens
  misc_feature: 54152.44.62.F07.1.pb.heavy.1.raw 54152
cgtaaatcgcctccctcgcgccatcagacagtatataccacgaccggtgctcgatttagtagtcgcataaagggaaaaaggggaagctctgagagaggagcccagccctgggattttcaggtgtcttcatttggtgacccaggctgaccgaacagagagaagtctccatggagtttgggctgagctgcctttttcttgtggcttttttaaagggtgtcgtgtgtgaagtgcagttgttggagtctggggggggcctgattcggcctgggaggtccctgacccctctcctgtgcggcctctggattcacctttagttggcctatggcatgacctgggtccgccgggctccagggaggggactggagtgggtctcaagtatcggagctggtggtgtcacactttctacggagactccgtgaagggccgcttcaccatttccagggacaatttcgcaggacaaattgtttctccaaatgaaaaaacctgagacccgaggacaacaggcgtctattactgttttgaaagccaggacccacggtgaccccccatgacacctttagtacttggggccgggggacagtggtgaccgttctcttcagcctccaccaaggggcccatcggtctttccccctggcgccctgctccaggagcacctccgagagcacagcggccctggggctgcctggtccaaaggactaccttcctatatactgtctgagcgggctggcaaggcgcatag

SEQ ID NO: 792539 - DNA, 716 bp, Homo sapiens
  misc_feature: 54154.UNK.UNK.UNK.pb.heavy.1.raw 54154
ctatgcgccttgccagcccgctcagacagtatataggaagtagtccttgaccaaggcagccagggccgctgtgcccccagaggtgctcctggagcagggcgccagggggaagaccgatgggcccttggtggaagctgaggagacggtgaccagggttccctggcccccaggggtcgaaccaatttcccatgtgtgggactatgagaggacttatgaaagttgacgagggctctcgcacaagaaatagatgggccgtgtcttcagatttctcagccctgctcagctccattgtagggctgtactcgtggattcgtccgcggtaatggtgactctgtcctgaaaaacttctgtggcgtaattcggtgccaccaaagatagggatgatcctcccagccactcaagcccttgtccaggggcctgtcgcacccaaataaaagcatagctgaaagaaaggtggcctccagaagcctctgcaggagaccttcaccgaggaccccagggcttcttcacctcagccccagactgcaccagcttgcacctgggactggacaccctgtagctgctgccaccacaaagaggaaccgccaggtccagtccatggtggatgagctgtgctcccaggggctttctttagaggaggagttgtggttgttatgtgatccaaaatcgagcaccgtcgtgtatatactgtctgatggcgcgagggaggcgatacg

SEQ ID NO: 792540 - DNA, 696 bp, Homo sapiens
  misc_feature: 54161.44.45.E01.1.pb.heavy.1.raw 54161
cgtatcgcctcccctcgcgccatcagacagtatatacacgaccggtgctcgatttagtgagtcagtaagggaaaggggctgggagaggagcccagcactagaagtcggcggtgttccattcggtgatcagcactgaacacagaggactcaccatggagtttgggctgagctgggttttcctcgttgctcttttaagacggtgtccagtgtcagttcagctgggtggagtctgggggagggcgatggatcccagcctgggacgtccctgagactctcctgtgttgcgtccggactcagtttcagtgactctgccatgcactgggtccgccaggctccaggcaaaggggctggagtgtgggtggcagtcatctggtctgatggaagaaataaagaatactatggagaactccggtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggccctgggctgcctggtcaaggactactttcctatatactgtctgagcgggctggcaaggcgcatag

SEQ ID NO: 792541 - DNA, 714 bp, Homo sapiens
  misc_feature: 54201.44.36.D03.1.pb.heavy.1.raw 54201
cgtatcgcctccctcgcgccatcagacagtatatacacgaccggtgctcgatttagctgcgtcacgattctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctggggaggcttggtacagcggggggggtccctgagactctcctgtgcagcctctggattcatcttcagtgactatgccatgaactggtccgccaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggaccacggctgtctacttctgttcgagagatcgggccacttggtcagtggctggttttgactactggggccggggaaaccctggtcaccgtctcctcagcctccaccaagggcccatcggtcttccccctggcgccctgctccaggagcacctccgagagcacagcggccctggctgcctggttcaaggactacttcctatatactgtctgaagcgggctggcaaggcgcatag

SEQ ID NO: 792542 - DNA, 727 bp, Homo sapiens
  misc_feature: 54209.44.86.H09.1.pb.heavy.1.raw 54209
cgtatcgcctccctcgcgccatcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 792543 - DNA, 722 bp, Homo sapiens
  misc_feature: 54210.44.86.H09.1.pb.heavy.1.raw 54210
ctatgcgccttgccagcccgctcagacagtatataggaagtagtccttgaccaggcagccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcaggacctcccaggctggaccacgcctccccagactccaccagcttcacctgacactggacacctcttaaaaagagcaacgaggaaaacccaggtcagcccaaactccatggtgagtcctctgtgttcggttctgatcacgactgaaacaccgccgacttctggtgctgggctcctctcccagagctccccaacccaagtctatagcactaaatcgagcaccggtcgtgtatatactgtcatggcgcgagggaggcgatacg

SEQ ID NO: 792544 - DNA, 742 bp, Homo sapiens
  misc_feature: 54214.UNK.UNK.UNK.pb.heavy.1.raw 54214
ctatgcgcccttgccagccgctcagacagtatataggaagtagtccttgaccaaggcagccccagggccgctgtgcccccagaggtgctcttggaggagggtgccagggggaagaccgatgggcccttggtggaggcggaggcgacgcggtgaccagggttccctggccccagaaggtcaaaacgaataataaccatccactaccgagcgccgacttgtctcgcacagtaatagacggccgtgtcgtcgcctctcaggttgttcatttgaagataaacccgtgttcctggaattgtccctggagatggtgaatcggccccttcacggagtctgcgtagtatgtgaaatcaccagtataaatgactgagacgcactccagccccttccctggagcctggcggacccaactcatgtagttgctgctgacggctggaggcccagaggctgcacaggagagtctctgggacccccccccaggctggcactaagcctcctccagacccatcagcccgcaccatcacactggacaccttttaaaagtccaacaaggagaaccccagccagtcagcccaaaactcccatggtgagtcctctgtgttcagtggctgatcaccgaaaatggaaacacctccggaatcccagtgctgggcttcctctcccccccaaacccaatatgtaatacctctaaatcgagcaccggtcgtgtatatactgtctgatggcgcgcgagggaggcgatacg

SEQ ID NO: 792545 - DNA, 616 bp, Homo sapiens
  misc_feature: 54272.UNK.UNK.UNK.pb.heavy.1.raw 54272
gaaggctggcaggctatgcaccctggtccaggtcaaaagctgcggacccgctagcggccatcttggcccactaggggtcccgcagattcatattgtcgtctagcatgcacaatgctgcaaaccagcttgcaatgcccacagcaagcggccatctttacgccacgttgaattgtttattacctgtgactggctatggcttgcaaccgccactcgtaaaactaagtactttgcggttaggggaagtagacaaacccattacttccacttcccggaagttcaactcattccaacacgaaataaaagtaaactcaacaccccaagcaggctatgtgggggggtgataggggtggattctatttcctatccatcccctaggatctcaattaagttactagcgagttaaatgtctgtaggcgatcccgtcagtctatcgcggcgcatccaagacctgcctggcttggttgagcgtgcagtagaatcatcgataagctgcgagttaggtcgatcccagaccgcatctggcgcctaaacgttcagtggtagctagcgtccaccttcgactgtctaaaaggcaatatgtcgtccttagctccaagtccctagcaagcgtgtcggg

SEQ ID NO: 792546 - DNA, 697 bp, Homo sapiens
  misc_feature: 54283.44.36.D03.1.pb.heavy.1.raw 54283
cgtatcgcctccctcgcgccatcaggacagtatatacacgaccggtgctcgatttagctgcgtcacgatctctcttgggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttggccgcagtaaaaacaaattgccagctttatcacagagtacgccgcgtctgtgaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaagggcccatcggtcttcccctggcgcctgctccaggagcacctccgagagcacagcggccctgggctgcctggtcaaggactacttcctatatactgtctgagcgggctggcaaggcgcatag

SEQ ID NO: 792547 - DNA, 676 bp, Homo sapiens
  misc_feature: 54372.UNK.UNK.UNK.pb.heavy.1.raw 54372
cgtatcgcctccctcgcgcatcagacagtatatacacgacggtgctcgatttagacgcgatcgaaggtttggggcctgggagacgagccagcactggaagtcgccggtgtttccactcggtgatcatcactgaacacagaggactcacatggagtttgggctgagctgggtttcctcgttgccctcttaagaggtgtcatgtgtcaggtgcaattcgtggagtctggggaggcgtggcccagtagggggtccctgagactctcctgtgcagcctctggattcaccttcgataattggaatatgcagtggtccgcaggctccaggcgaggggctggagtgggtggcaggtgtgtcatttcatggaggaaatcaagtctacgtgattcgttgaggccgattcacatctccagagacaattccgagaacacagtgtctcttcaaatgaacagcctgagacctcaggacacggccgtgtattttttgcgagactatctgtttccaaaatcggttcattcgacgctggggccagggaacctggtcaccgtctcctcggcctccaccaagggccatcggtcttcccctggcgccctgctccaggagcactccgagagcacagcggcctggctgcctggtcaaggactacttcctatatactgtctgagcggctggcgcatag

SEQ ID NO: 792548 - DNA, 683 bp, Homo sapiens
  misc_feature: 54377.UNK.UNK.UNK.pb.heavy.1.raw 54377
ctatgcgccttgccagcccgctcagacagtatataggaagtagtccttgaccaggcacccagggcgctgtgctctcggaggtgctcctggagcagggcgccaggggaagaccgatggccttggtggaggctgaggagacgtgaccagggttccctggcccagtggacagttcctgataaaacacaacacaataatacatgccgtgtcctcggttttcaggttagtcattcgcagaatcaatgattcttgaagtcatctcttgagagggtgaatctggctttcacagacgcggcgtactctgtgataaagctggcaactttgttttactgcggccaagccactcagccccttccctggagcctggcggaccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagccgaactccatggtgagtcctctgtgttcagtgctgatcaccaaatgaaacacctgggaattctgggctgggctccgctctcagagctccccagagagatcgtgacgcagctaatcgagcacggtcgtgtatatactgtctgatggcgcgagggaggcgatag

SEQ ID NO: 792549 - DNA, 683 bp, Homo sapiens
  misc_feature: 54384.44.55.E11.1.pb.heavy.1.raw 54384
cgtatcgcctccctcgcgccatcagacagtatatacacgaccggtgctcgatttagcactcgcacgttgggtttggggagaggagcccagcactggattccgaggtgtttccattcggtgatcagcactgaacacagaggactcaccatggagttttggctgagctgggtctccttgttggacttttaaaaggtgtccagtgtgaggtgcggcgctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgatcaccatctccaggacaattccaggaacacggtttatcttcaatgaacacctgagaggcgacgacacggccgtctattactgtggagacaagtcggcgctcggagtgttattattcgtttgacttctggggccagggaaccctggtcaccgtcgcctccgcctccaccaagggcccatcggtcttccccctggcaccctcctccaagagcacctctggggcacagcggccctgggctggcctggtcaaggactacttcctatatactgtctgagcggctgg

SEQ ID NO: 792550 - DNA, 660 bp, Homo sapiens
  misc_feature: 54410.UNK.UNK.UNK.pb.heavy.1.raw 54410
ctatgcgccttgccagcccgctcagacagtatataggaagtagtcctgaccaggcagcccagggccgctgtgcccccagaggtgctcctggagcagggcgccaggggaagaccgatggcccttggtggaagctggaggagacagtgaccagggtgccaacggcccatagattgaaagaccagtctcgcctcgcacagaaataaacggccgtgtccgcggcgcggtcacggaggtcagtttcagggagaagcggttcatggacgtgtccctcgaaatggtgagacgactcttgagggacggagagtagtacgtcgccccagtataatggatgtcaccaatccactccattcccctccctgggggctggccggatccagcccaagaatgatcagaactgatggaaactccagagacagtgcagatgagagacagggtttcccgaaggcctcaccagtcctgggcccgactcctgcagctgcacctgggacaggacccatctgggagctgccaccagcaggagggaaaaaccacaggtgcttcatgttcttgcacaggaaggtccttgactctcagaaagcatccccaacccaagtctatagcactaaatcgagccaccgcgtcgtgtatatactgtctgatgggcgcgagggaggcgatacg

SEQ ID NO: 792551 - DNA, 712 bp, Homo sapiens
  misc_feature: 54458.UNK.UNK.UNK.pb.heavy.1.raw 54458
cgtatcggcctccctcgcgccatcagacagtatatacacgaccggtgctcgatttagcctgcgtcacgatctctcttggggagctctgagagcggagccccagcccccagaattcccaggtgtgtttcatttggtgatcagcactgaacacaggaggactcaccatggagttcgggctgagctgggttttccttgttgttattttacaaggtgtccagagtgaagtgcagttggtggagtccggggggagacttggtccagcctggaggggtcccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagcccagattcaccctctcaagagatgacttcaagactcattgattctgcgaatgactaacctgaaaaccgaggacacgggcatgtattattgtgttgtgtttatatcaggaactgtcactggggcccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 792552 - DNA, 609 bp, Homo sapiens
  misc_feature: 54477.UNK.UNK.UNK.pb.heavy.1.raw 54477
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctattttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 792553 - DNA, 720 bp, Homo sapiens
  misc_feature: 54481.UNK.UNK.UNK.pb.heavy.1.raw 54481
cgtatcggcctccctcgcggccatcagacagttataacacgacgcggctgctcgatttagctgcgtcacgattctctcttggggagctctgagagcggagccccagccccagaattcccaaggtgttttcatttggggtgatcagcactgaacacagaggactcaccatggagttcggggctgagctggggttttccttgttgttattttacaaggtgtccagagtgagtgcagttggtggagtccgggggagacttggtccagcctggagggtccctgagactctcctgtgtcgcctctggattcaccatcagtgaccactatatggactggggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgttattattgtgttgtgtttatatcaggaactgtccactgggccagccaggaaaccctggtcaccgttctcctcagcctccaccaagggcccatcgtctttcccctggcgccctgctccaggagcacctccgagagcacagcggccctgggctgcctggtcaaggactcacttcctatatactgtctgagcgggcctggcaaggcgcatag

SEQ ID NO: 792554 - DNA, 707 bp, Homo sapiens
  misc_feature: 54498.UNK.UNK.UNK.pb.heavy.1.raw 54498
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacggcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctggggctccgctctcagagctccccaagagagatcgtgacgccagctaaatcgagcaccggtcgtgtatatactgtctgatggcgcgagggagggcgatacg

SEQ ID NO: 792555 - DNA, 648 bp, Homo sapiens
  misc_feature: 54589.44.23.C01.1.pb.heavy.1.raw 54589
cgtatcgcctcctcgcgccatcagacagtatatacacgaccggtgctcgattagtacacgtgattagggattgggggctttctgagagtcaaggacctcctgtgcaagacatggaagcacctgtggtttttcctcctgctggtggcagctcccagatgggtcctgtcccaggtgcagctgcaggagtcggcccaggactggtgaggccttcgggaaccctgtctctcatctgcactgtcctctggagtttccatcagtttctgatcattcttggggctggatccggcagccccagggagggaatggagtggattggtgacatccattatactggggcgaccgtactactctccgtcctcaagagtcgtctcaccatttcgagggacacgtccatgaaccgcttctccctgaaactgacctccgtgaccgccgcgacacggccgtttatttctgtgcgaggcgagactggtcttcaatctatggggccggtggcaccctggtcactgtctcctcagcttccaccaagggccatcggtcttcccctggcgcccctgctccaggagcacctctgggggcacagcggccctgggctgcctggtcaaggactacttcctatatactgtctgagcgggctggcaaggcgcatag

SEQ ID NO: 792556 - DNA, 699 bp, Homo sapiens
  misc_feature: 54601.44.55.E11.1.pb.heavy.1.raw 54601
cgtatcgcctccctcgcgccatcagacagtatatacacgaccggtgctcgatttagcactcgcacgttgggtttgggagaggagcccagcactgggattccgaggtgtttccattcggtgatcagcactgaaacaccagaggactcaccatggagttttggctgagctggggttctcctgttggacttttaaaaggtgtccagtgtgaggtgcggctgatggagtctggaggaggcttagtccagcctggggggtccagagactctcctgtgcagccctctgggctcaccgtcagcagcaactacatgagttgggtcgccaggctccagggaaggggctggagtgggtctcagtcatttatactgggatttcacatactacgcagactccgtgaagggccgattcaccatctccagggacaattccaggaacacggtttatcttcaaaatgaacaacctgagagggcgacgacacggccgtctattactgtgcgagacaagtcggcgctcggagtggttattattcgtttgaacttctgggccagggaaccctggtcaccgtcgcctccgcctccaccaagggccatcggtcttcccctggcaccctcctccaagagcacctctggggcacagcggccctgggctgcctggtcaaggactacttcctatatactgtctgagcggctgcaaggcgcatag

SEQ ID NO: 792557 - DNA, 594 bp, Homo sapiens
  misc_feature: 54676.44.78.H01.1.pb.heavy.1.raw 54676
cgtatcgcctccctcgcgccatcagacagtatatacacgaccggtgctcgatttagtgtgagtagtttgggtttggggggaagaggaagactgacggtcccactcccaggtacagctggtgcagtctgggctgaggtgaagaagcctggggcctcagtgacagtctcctggcacggcttctggatacacgttcatcaattatgatattaactgggtgcgacaggcgctggacaagggctggagtggatgggatggatgaagccctatagtggcaacacgggctttgcccagaagttccaaggcagagtttagtatgaccaggagcacctccccaggtacagtctacatggaactggcagcctgagatctgaggacacggccgtgtatttttctgtgcgagagccaccagcacctggcttgacttgtggggccagggaaccctggtcaccgtctcctcagcctccaccaagggcccatcggtctttccccctggcgccctgctccaggagcacctccgagagcacagcggccctgggctgcctggtcaaggactacttcctatatactgtctgagcgggctggcaaggcgcatag

SEQ ID NO: 792558 - DNA, 670 bp, Homo sapiens
  misc_feature: 54683.UNK.UNK.UNK.pb.heavy.1.raw 54683
ctatgcgccttgccagcccctcagacagtaataggaagtagtccttgaccagggcagccagggcgctgtgccccagaggtgctcttggaggagggtgccaggggaagaccgatgggcccttgtggaggcggaggcgacggaccagggttccctggccccagaagtcaacgaataaaccactccgagcgccgacttgtctcgcacagtatagacggccgtgtcgtcgcctctcagggttgttcatttgagataaaccgtgttcctggaattgtccctggagatggtgaatcggcccttcacggagtctgcgtagtatgtgaaatcaccagtataatgactggacccctcagcccctccctggagctggcggacccactcatgtagttgctgctgacggtgagcccagaggctgcacaggagagtctctgggaccccccggggcggactaagcctcctccagactccatcaccgcactcacactggacaccttttaaaagtccacaaggagaacccagctcagccaaactccatggggtcctctgtgtttcagtgctgatcaccgaatggaaaccctcggaatccagtgcgggctcctctccccccaacaacgtgcgagttgaaatcgacgccggtgtgtatactgtctgatggcgcgagggaggcgatacg

SEQ ID NO: 792559 - DNA, 610 bp, Homo sapiens
  misc_feature: 54687.UNK.UNK.UNK.pb.heavy.1.raw 54687
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttctc

SEQ ID NO: 792560 - DNA, 546 bp, Homo sapiens
  misc_feature: 54698.UNK.UNK.UNK.pb.heavy.1.raw 54698
cgtatcgcctccctcgcgccatcagacagtatatacacgaccgtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccaggaaccctggtcaccgtctcctcagcttccaccaaggcccatcggtcttccccctggcgccctgctccaggagcacctctgggggcacagcggcctgggctgcctggtcaaggactacttcctatatactgtctgagcgggctggcaaggcgcatag

SEQ ID NO: 792561 - DNA, 706 bp, Homo sapiens
  misc_feature: 54702.44.85.H08.1.pb.heavy.1.raw 54702
cgtatcgcctcctcgcgccatcagacagtatatacacgaccggtgctcgatttagtatcactcagtcgcggggagctctgggagaggagccagcactagaagtcggcggtgtttccattcggtgatcagcactgaacacagaggactcaccatggagtttggctgagctgggtttcctcgttgctcttttaagaggtgtccagtgtcaggtgcagctggtggagtctggggaggcgtggtccagcctgggaggtccctgagactctcctgtgcagcgtctggattcaccttcagtactatggcatgcactggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgagacacggctgtgtattactgtgcgaggacatattgtagtactaccacctgctgggactactactacggtatggacgtctggggccaaggaccacggtcaccgtctctcagcctccaccaagggcccatcggtcttcccctggcacctcctccaagagcacctctggggcacagcggccctggctgcctggtcaggactacttcctatatactgtctgagcgggctggcaggcgcatag

SEQ ID NO: 792562 - DNA, 708 bp, Homo sapiens
  misc_feature: 54800.UNK.UNK.UNK.pb.heavy.1.raw 54800
ctatgcgccttgccagccccgctcagacagtatataggaagtagtccttgaccaggcagcccagggccgctgtgcccccagaggtgctcctggagcagggcgccaggggaagaccgatgggcccttggtggaagctgaagaggacggtgaccattgtcccctgggccccaaatatcaaatgcatcgacgtcccaggatcgcctggcgcagtaatagacgcctgtgtcgtcgcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactggaatcctgagactacacaggagagtctcagagaccgccctggctgtgccaagcccccccgactccgccagtcgcccctcgcactggacaccttctaaaaaaaactacaaggaaaatcaagattagcccaaactccatggttggtggtctgtgctcagtgctgatcaccaagtggaaactcctgggaatctcacggctggcggctgggctcctctctctttgcgacgacactaaatcgagcaccgtcgtgtatataactgtctgatgggcgcgagggaggcgatacg

SEQ ID NO: 792563 - DNA, 638 bp, Homo sapiens
  misc_feature: 54844.UNK.UNK.UNK.pb.heavy.1.raw 54844
ctatgcgcttgcagccgctcagacagtatataggaagtagtcttgaccaggcagcccaggccgctgtgccccagagtgctcctgagcagggcgccaggaagaccgatggcccttggtggaagctgagtgacaagaccagggtcctgccccccagatctcaaaggctccatgcgagctgggtacggacctctgcacaagtagtaacggccgtgtcgtcggatttcaaagaactcattgtcatgagactgtgtctgtgacttgtccgcgtatcgtaaaatcggcccggaatgtctcggtgcgtaggtgagtgagccaaaagaggatgattcccaccatccactcaagccctttccagggcctggcgcaccagttgatgtataagtagtggactggtaacttccagagccgtgcaggaaaggtcaccgaggaccaaggttgcggcattctagtccagactgcaccagtttgcaccagggactggacactgttgctgctgccacacaaagagaacctccaggtccagtccatggtgatgagctgtgctcccagggcttcttagaggaggaatgtggttgtcagtagatctaaatcgagcacgtcgtggtatatactgtctgatggcgcgaggaggcgatacg

SEQ ID NO: 792564 - DNA, 646 bp, Homo sapiens
  misc_feature: 54847.44.86.H09.1.pb.heavy.1.raw 54847
cgtatcgcctccctcgcgccatcagacagtatatacacgaccggtgctcgatttagtgctatagacttgggtttggggatgctttctgagagtcaaggacctcctgtgcaagaacatgaagcactgtggtttttcctcctgctggtggcagctcccagatgggtcctgtccaggtgcagctgcaggagtcgggcccaggactggtgaggccttcggaaccctgtctctcatctgcactgtctctggagtttccatcagttctgatcattcttgggctgatccggcagcccccagggagggaatggagtggatgggtgacatccattatactggggcgacgtactactctccgtcctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcacctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792565 - DNA, 677 bp, Homo sapiens
  misc_feature: 54849.44.36.D03.1.pb.heavy.1.raw 54849
cgtatcgcctcctcgcgccatcagacagtatatacacgaccggtgctcgatttagctgcgtcacgatctctcttgggagctctgagagcggagcccagccccagaattccaggtgttttcatttggtgatcagcactgaacacagaggactcaccatggagttcgggctgagctgggttttccttgttgttattttacaaggtgtccagagtgaagtgcagttggtggagtccgggagacttggtccagcctggagggtcctgagactctcctgtgtcgcctctggattcaccatcagtgaccactatatggactggtcgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggc

SEQ ID NO: 792566 - DNA, 613 bp, Homo sapiens
  misc_feature: 54944.44.38.D05.1.pb.heavy.1.raw 54944
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacggtgaccgtggtcccttggcccagacgtccataccgtagtagtagtatgcaactcccgaactccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttcctggagcttggcggacccagtgcatccagtagctactgaaggtgaatccagaggctgcacaggagagtctcagggacccccaggctgaactaagcctcccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 792567 - DNA, 699 bp, Homo sapiens
  misc_feature: 54974.44.36.D03.1.pb.heavy.1.raw 54974
ctatgcgccttgccagcccgctcagacagtatataggaagtagtccttgaccaggcagccagggccgctgtggctctcgaggtgctcctggagcagggcgccagggagaccgatggcccttggtggaggctgaggagacggtgaccagggttccctgcccccagtggacagttcctgatataaacacaacacaataatacatgccgtggcggctcggttttcaggttagtcattcgcagaatcaatgagttctttgaagtcatctcttgagagggtgaatctggctttcacagacgcggcgtactctgtgataaagctggcaactttgttttttactggcggccaagccactccagccccttccctggagcctggcggacccagtcatatagtggtcactgatggtgaatccagaggcgacacaggagagtctcaggaccctccaggctggaccaagtctcccccggactccaccactgcacttcactctggacacctgtaaaataacaacaaggaaaacccagctcagcccgaactccatggtggagtcctctgtgttcagtgctgatcaccaaatgaaaaaacacctgggaatctggggctggggctcgctctcagagctccccagagagatcgtgacgcagctaaatcgagcaccggtcgtgtatatactgtctgatggcgcgaggaggcgatacg

SEQ ID NO: 792568 - DNA, 1361 bp, Homo sapiens
  misc_feature: 55045.44.36.D03.1.pb.heavy.1.raw 55045
cgtatcgcctccctcgcgccatcagacagtatatacacgaccggtgctcgatttagctgcgtcacgatctctcttggggagctctgagagcggagcccagcccagaattcccaggtgttttcattggtgatcagcactgaacacagaggactcaccatggagttcgggctgagctgggttttccttgttgtattttacaaggtgtccagagtgaagtgcagttggtggagtccggggagacttggtccagcctggagggtccctgagactctcctgtgtcgcctctggattcccatcagtgaccactatatggactgggtccgccaggctcagggaaggggctggagtggctggccgcgtaaaacaaaagttgccagctttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactggggccaggaaccctggtcaccgtctcctcagcctccaccaagggcccatcggtcttcccctggcgcctgctccaggagcacctccgagagcacagcggccctgggctgcctggtcaaggactacttcctatatactgtctgagcgggctggcaaggcgcatagcgtatcgcctccctcgcgccatcagacagtatatacacgaccggtgctcgatttagatctactgacaaccacattcctcctctaaagaagccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcgacaagtccacagacacagtctccatgacaatgagttctttgaaatccgacgacacggccgtctactactgtgcgaggaggtccgtaccccagctgcatggagcctttgagatctgggggcagggaaccctggtcattgtcacctcagcttccaccaagggcccatcgtcttccccctggcgccctgctccaggagcacctctggggcacagcggccctggctgcctggtcaagactacttcctatatactgtctgagcgggctggcaaggcgcatag

SEQ ID NO: 792569 - DNA, 647 bp, Homo sapiens
  misc_feature: 55052.44.86.H09.1.pb.heavy.1.raw 55052
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaacgcttctccctgaaactgacctccgtgaccgcgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggcctgggctgcctggtcaagactacttcctatatactgtctgagcgggctggcaaggcgcatag

SEQ ID NO: 792570 - DNA, 667 bp, Homo sapiens
  misc_feature: 55067.44.38.D05.1.pb.heavy.1.raw 55067
cgtatcgcctcctcgccgccatcagacaggtactatacacgaccggtgctcgatttagtatctgatagttggtttggggggaagaggaagactgacggtcctcccaggagttcaggtgctgggcaccttgggtacgggggaggtgtgtcacaagatttgggctctgggcaccgtgggcatgggggaggcttagttcagcctgggggggtccctggagactctcctgtgcagctctggattcaccttcagtagctactggatgcactgggtccgccaagctccagggaaggggctggtgtgggtctcacgtattaatagtgatgggagtagcacaagctacgcggactccgtgaaggggccgattcaccatcccagagacaacgccaagaacacgctgtatctgcaaatgaacagtctgagagccgaggacacggctgtgtattactgtgcaagagccgggcgggagttcggggagttgcatactactactacggtatggacgtctgggccagggaccacggtcaccgtctcctcagcttccaccaagggcccatcggtcttccccctggcgccctgctccaggagcacctctggggcacagcggcctgggctgcctggtcaaggactacttcctatatactgtctgagcgggctgcaaggcgcatag

SEQ ID NO: 792571 - DNA, 671 bp, Homo sapiens
  misc_feature: 55084.44.12.B01.1.pb.heavy.1.raw 55084
ctatgcgccttgccagcccgctcagacagtatataggaagtagtccttgaccaggccagcccaggggcgctgtgccccccagaggtgctcttggaggagggtgccagggggagaccgatgggcccttggtggaggctgaggagacggtgaccagggttccctggcccccagtggtcaaagtagttggtgacgaactgccctactctcgcacagtaatacacggccgtgtccgcggcggtcacagagctcagcttcaggagaactggtttcttggacgtgtctactgatatggtgactcgactcttgagggacgggttgtagtaggtgctcccactataatagatactcccaatccactccagccccttccctgggggctggcggatccagccccagtagtaactactactggctgatggagccaccagagacagtgcaggtgaagggacagggtctccgaaggcttcaccagtcctggacccggactcctgcagctgcagctgggacaggacccatctgggagccgccaccagcaggaggaagaaccacaggtgcttcatgttcttgcacaggaggtccatgactctcagaaagccccccgcggaatctacactactaaatcgagcaccggtcgtgtatatactgtctgatggcgcgagggaggcgatacg

SEQ ID NO: 792572 - DNA, 754 bp, Homo sapiens
  misc_feature: 55105.44.86.H09.1.pb.heavy.1.raw 55105
cgtatcgcctccctcgcgccatcagacagtatatacacgaccggtgctcgatttagtgctatagacttgggttggggagctctgggagaggagcccagcaccagaagtcggcggtgtttccagtcggtgatcagcaccggaacacagaggactcaccatggagtttgggctgacctgggttttcctcgttgctcttttaagaaggtgtccagtgtcaggtgaagctggtggagtctgggggaggcgtgggtccagcctgggaggtccctgagactctcctgtgtaggcgtctggattcaccttcaacagacatggcatgcactgggtccgcccaggcctccaggcaagggactggaggtgggtggccacttatatggtatgatggaagtaagtaaataattatgtagattccgtgaagggcgagtttcagccatctccagagacaattcgaagaaccacactatatctggaaaatgaatagcctgagagcgaggacacggctgtctactactgtgcgagaagatggggctctcgtggatacagatatgacatgctctactccaatggtatggacgcctggggccaagggaccacggtcgccgtctcctcagcctccaccaagggggcccatcggtctttccccctgggcaccctctcctccaagagcacctctgggggcagcagcggccctggggctgcctggtcaaggactacttcctataatactgtctgagcgggctggcaaggcgcatag

SEQ ID NO: 792573 - DNA, 727 bp, Homo sapiens
  misc_feature: 55124.44.86.H09.1.pb.heavy.1.raw 55124
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggcgaccgtggtccctttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtccttgcctggagcctggcggacccagtgcatgccatgtctgttgaaggtgaatccagacgctacaccaggagagtctcagggacctcccaggctggaccacgcctcccccagactccaccagcttcactgacacggacacctcttaaaagagcaacgaggaaacccaggtcagcccaaactccatggtgagtcctctgtgttcggtgctgatcaccgactggaaacaccgccgacttctggtgctgggctcctctcccagagcttccccaacccaagtctatagcactaaatcgagcaccggtcgtgtatatactgtctgatggcgcgagggaggcgatacg

SEQ ID NO: 792574 - DNA, 733 bp, Homo sapiens
  misc_feature: 55126.UNK.UNK.UNK.pb.heavy.1.raw 55126
tctatgcgccttgccagcccgttcagacagtatataggaagtagtccttggaccaggcagcccagggccgctgtggcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgccatagtatttattacttccatcataccatataagtgccacccactccagccccttgcctggagccctggcggacccagtgcatgcataggtactgaaggtgaatccagacgctgcacaggagaggtctcagggacctcccaggctggaccacgcctccccagactccaccagctgcacctgacactggacacctcttaaaagagcaacgaggaaaaacccagctcagcccaaactccatggtgagtcctctgtgttcagtgctgatcaccgaatggaaacaccggccgacttctagtgctgggctcctctccagagctccccgccgactggagtgattactaatcgagccaccggtcgtgtatatactgtctgatggcgcgcgagggaggcgatacg

SEQ ID NO: 792575 - DNA, 702 bp, Homo sapiens
  misc_feature: 55139.44.67.G01.1.pb.heavy.1.raw 55139
cgtatcgcctccctcgcgccatcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcggtcttcccctggcaccctcctccaagagcacctctggggcacagcggccctgggctgcctggtcaaggactacttcctatatactgtctgagcgggctgcaaggcgcatag

SEQ ID NO: 792576 - DNA, 739 bp, Homo sapiens
  misc_feature: 55141.44.33.C11.1.pb.heavy.1.raw 55141
cgtatcgcctcccctcgcgccatcagaccagtatatacacgaccggtgctcgatttagagtgagctcgttgggttttggggctgggagaggagcccagccacccagaagtcggccggtgtttccagtcggtgatcagcaccgaacacagaggactcacccatggagtttgggcctgacctgggttttcctcgttgctcttttaagaggtgtccagtgtcaggtgaagctggtggagtctgggggaggcgtgtcagcctgggaggtccctgagactctcctgtgtagcgtctggatttcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctgaaatgaatagcctgagagccgaggaacacggctgtctactactgtgcgaggatggggctcgtggatacagatatgacatgctctactccgaatggtatgggacgcctggggccaaggggacccacggtcgccgtctcctcgcgcctccaccaagggcccatcggtcttcccccctggcacgcctctccaagagcacctctggggcaccagcggccctggctgcctggtcaaggactacttcctatatactgttctgagcgggctggcaaggcgcattag

SEQ ID NO: 792577 - DNA, 572 bp, Homo sapiens
  misc_feature: 55142.44.78.H01.1.pb.heavy.1.raw 55142
ctatgcgccttgccagcccgctcagacagtatataggaagtagtcctgaccaggcagcccagggccgctgtgctctcggaggtgctcctggagcagggcgccagggggaagaccgatgggcccttggtggaggctgaggagacggtgaccagggttccctgggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaaagccgtgcaggagactgtcactgagggccccaggcttcttcacctcagcagcgtggtgaccgtgacctccagcaactcggcacccaaaccaaactactcacactaatcgagcaccggtcgtgtatatactgtctgatggcgcgagggaggcgatacg

SEQ ID NO: 792578 - DNA, 643 bp, Homo sapiens
  misc_feature: 55148.UNK.UNK.UNK.pb.heavy.1.raw 55148
cgtatcgcctccctcgcgccatcagacagtatatacacgaccggtgctcgatttagtagtctcataagggaaatgcttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggaggggaatggagtggattggtgacatccattatactgggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcggtcttcccctggcgccctgctccaggagcacctctgggggcacagcggccctgggctgcctggtcaaggactacttcctatatactgtctgagcgggctggcaaggcgcatag

SEQ ID NO: 792579 - DNA, 692 bp, Homo sapiens
  misc_feature: 55200.UNK.UNK.UNK.pb.heavy.1.raw 55200
cgtatcgcctccctcgcgccatcagacacagtataaaacagacggtgctcgatttagtagctctatcaggggagcatcacataacaaccacattcctcctctaaagaagcccctgggagcacagctcatcaccatggactggacctggagttcctctttgtggtggcagcagcaacaggtgtccagtccctggtgcaaactgtgcagtctgggactgaatgccgcaaccttggtcctcggtgaccctttcctggcacggcctctggaagtactaccaagttccactacttataccatcaactgggtgcgccaggccctggacaagggcttgaagtggatgggtggaatcatccctcttttttggctcactcacctacgcacgagacttccgggcagaattacgattaccgcggacaagtccacagacacagcttccatgacaatgagttctttgaaatccgacggacacggccgtctactactgtgcgagaggtccgtaccccagctcgcatggagcctttgagatctgggggcagggaaccctggtcattgtcacctcagcttccaccaaggcccatcggtcttcccctggcgccctgctccaggagcacctctggggcacagcggccctgggctgcctggtcaaggactacttcctatatctgtctggagcgggctggcaaggcgcatag

SEQ ID NO: 792580 - DNA, 700 bp, Homo sapiens
  misc_feature: 55205.44.36.D03.1.pb.heavy.1.raw 55205
ctatgcgccttgccagcccgctcagacgtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggcttcacagacgcggcgtactctgtgataaagctgggcaactttgtttttactgcggccaagccactccagcccccttcctggagcctggcggacccagtccatatagtggtcactgatggtgaatccagaggcgacacaggagagtctcagggacccctccaggctgaccaagtctcccccggactccaccaactgcacttcatctggacaccttgtaaaataacaacaaggaaacccagctcaggcccgaactccatggtgagcctctgtgttcagtgctgatcaccaaatgaaacacctgggaattctggggctggggctccgctctcagagctccccaagagagatcgtgacgcagctaaatcgagcaccggtcgtgtatatactgtctgatggcgcgagggaggcgatacg

SEQ ID NO: 792581 - DNA, 565 bp, Homo sapiens
  misc_feature: 55228.UNK.UNK.UNK.pb.heavy.1.raw 55228
cgtatcgcctccctccgcgccatcagacagtatatacacgaccggtggctgatttagtagcatactgttggtttgggggaggcgtggtcagccggaggtccctgagactctcctgtgtagcctctgttctcattcgatagatttgggtttgcactgggtccgccaggctccaggcaagggccggagtgggtggcagtcatctccgacgatggaagtgagaagtattactcagactccgtgaagggccgattcacatctccagagacaattccaagaatatgctgtatttgcaaatgaacagcgtgagagttgacgacacgtctgtttattactgtgcgagggggacctccaaggaaacggtttcggggaatcataaactactactatttgatggatgtctgggcagggggacgtcggtcaccgtctctcagctttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 792582 - DNA, 666 bp, Homo sapiens
  misc_feature: 55277.UNK.UNK.UNK.pb.heavy.1.raw 55277
ctatgcgccttgccagcccgctcagacagtatataggaagtagtccttgaccaggcagccagggccgctgtgcccccagaggtgctcttggaggagggtgccagggggaagaccgatggccttggtggaggctgaggagacggtgaccagggttccctggcccagggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagtggtgctgccactgttatagatgcgcccaatccactccagtcccttccggcgactgccgcagccaactccaataataactactgatgtaaccacagagacattgcaggtgaggacagggtctccgaaggcttcacccgtcctgggcccgactcctgcagctgcacctcggacacgacccatctgggaggtgccaccaggaggaggaagaaccacagtgtttcatgttcttgtgcaggaggcccatgagtctcagaagtatccccaaacccaactatcgtgtgcaaatcgagcaccggtcgtgtatatactgtcctgatggcgcgagggaggcgatacg

SEQ ID NO: 792583 - DNA, 549 bp, Homo sapiens
  misc_feature: 55279.44.43.D10.1.pb.heavy.1.raw 55279
cgtatcgcctcctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctacagtggtaacacaggctatgcacagaagttccagggcagagtcaccatgaccaggaacacctccataaaacacagcctacatggagctgagcagcctgagatctgaggacacggccgtgtattactgtgcgagatcccgaaagtatagcagctcgtcggggaggtggttcgacccctgggggcccagggaaccctggtcaccgtctcctcagctccaccaaggcccatcggtctttccccctggcgccctgctccaggagcacctctggggcacagcggccctgggcctgcctggtcaaggactacttcctatatactgtctgagcggctggcaaggcgcatag

SEQ ID NO: 792584 - DNA, 669 bp, Homo sapiens
  misc_feature: 55283.44.35.D02.1.pb.heavy.1.raw 55283
cgtatcgcctccctcgcgccatcagacagtatatacacgaccggtgctcgatttagcacacgatagttgggtttggggatactttctgagactccatgggcctcctgcacaagaacatgaaacacctgttggttcttcctcctcctggtggcacctcccagatgggtcgtgtccgaggtgcagctgcaggagtcgggccagacgggtgaaggccttccggagaccctgtccctcacctgcaatgtctctggtggttacatcagtagttattattggagttggctgcggcagtcgccggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacgccgtatattattgtgcgagagattcctatcgatacagtagagacggggggcgaactgctcgaccctccaggaaccctggtcaccgtctcctcagcctccaccaagggccccatcggtctccccctggcactcctccaaagagcacctctgggggcacagcggccctggctgcctggtcaaggactacttcctaatatactgtctgagcgggctggcaaggcgcatag

SEQ ID NO: 792585 - DNA, 662 bp, Homo sapiens
  misc_feature: 55313.44.12.B01.1.pb.heavy.1.raw 55313
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacggttgtagtaggtgctcccactataatagatactcccaatccactccagccccttccctgggggctggcggatccagccccagtagtaactactactgctgatggagccaccagagacagtgcaggtgagggacagggtctcgaaggcttcaccagtcctggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 792586 - DNA, 699 bp, Homo sapiens
  misc_feature: 55320.44.12.B01.1.pb.heavy.1.raw 55320
ctatgcgccttgccagcccgctcagaacagtatataggaaagtagtcttgaccaggcagcccagggcccgctgtgcccccagaggtggctcttggagggaggggtgccaggggaagaccgatgggcccttggtggaggcttgaggagacggtgaccagggtttccctggccccagtgggtcaaaagtagttggtgacgaactgccctactctcgcacagtaatacacggccgtgttccgcgggcggttcacagagctcagcttcagggagaactgggttcttggacgtgtctaactgatatggtgactcgaactcttgaggggacgggtttgtagtaggtgctccccactataatagataactcccaaattccactccagcccccttccctgggggctggcggatccagccccagtagtaactactactgctgatggaagccaccagagacagtggcaggtgaggggacagggtctccgaaaggccttccaccagtccctgggcccgactcctgcagctgcagctgggacaggaacccatctgggagccgccaccagcaggaggaagaaccacaggtgcttcatggttcttgcacaggaggtcccatgactctcagaaagcccccgcggaatctacactactaaatcgagcaccggtcgtgtatatactgtctgatggcgcgggagggagggcgatacg

SEQ ID NO: 792587 - DNA, 696 bp, Homo sapiens
  misc_feature: 55324.44.55.E11.1.pb.heavy.1.raw 55324
cgtatcgcctccctcgcgccatcagacagtatatacacgaccggtgctcgatttagcactcgcacgttgggtttgggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagagcgacgacacgccgtctattactgtgcgagacaagtcggcgctcggagtggttattattcgtttgacttctggggccagggaaccctggtcaccgtcgcctcgcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 792588 - DNA, 609 bp, Homo sapiens
  misc_feature: 55327.UNK.UNK.UNK.pb.heavy.1.raw 55327
cccgacacgcttgctagggacttggagctaaggacgacatattgcctttaggacagtcgaaggtgacgccttagctaccactgaaacgtttaggcgccagatgcggtctgggatgaacctaactcgcagcttatcgatgatctactgcacgctcaaccaaccaggtcttgatgcgcgcgataggactgacgggatcgctacagacatttaaactcgctagtaacttaattgagatcctagggatgggatagggaaatagaatccacccctatcaccccccacatagcctgcttggggtgttgagtttacttttatttcgtgttggaatgagttgaacttccgggaagtggagtaatggtttgtctacttcccctaaccgcaaagtactagttttacgagtggcgtttgcaagcatagccagtcacaggtaataaacaattcaacgtggcgtaaagatggccgcttgctgtgggcattgcaagctgggtttgcagcattgtgcatgctagacgacaatatgaatctgcgggacccctagtggccaagatggccgctagcgggttccgcagctttgacctggaccagggtgcatagcctgcccagccttcc

SEQ ID NO: 792589 - DNA, 712 bp, Homo sapiens
  misc_feature: 55350.44.36.D03.1.pb.heavy.1.raw 55350
ctatgcgccttgccagcccgctcagacagtatataggaagtagtccttgaccagggcagcccagggccgctgtgctctcggaggtgctcctggagcagggcgccaggggaagaccgatgggcccttggtggaggcctgaggagacggtgaccagggttccctggccccagtggacagttcctgatataaacacaacacaataatacatggcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaaataacaacaaggaaaacccagctcagcccgaactccatggtgagtcctctgtgttcagtggctgatcaccaaatgaaaacacctgggaattctggggctggggctccgctctcagagcctccccaagagagatcgtgacgcagctaaatcgagcaccggtcgtgtatatactgtctgatggcgccgagggagggcgatacg

SEQ ID NO: 792590 - DNA, 709 bp, Homo sapiens
  misc_feature: 55392.44.67.G01.1.pb.heavy.1.raw 55392
ctatgcgccttgccagcccgctcagacagtatataggaagtagtccttgaccaggcagcccagggccgctgtgccccagaggtggctcttggaggagggtgccagggggaagaccgatgggcccttggtggaggcggaggcgacggtgacccagggttccctggccccagaagtcaaacgaataataaccactcgagcgccgacttgtctcgcacagtaatagacggccgtgtcgtcgcctctcaggttgttcatttgaagataaaaccgtgttcctggaattgtccctggagatggtgaatcggcccttcacggagtctgcgtagtatgtgaaatcaccagtataaatgactgagacccactccagcccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaatatgtatactctaaatcgagcaccggtcgtgtatatactgtctgatggcgcgagggaggcgatacg

SEQ ID NO: 792591 - DNA, 662 bp, Homo sapiens
  misc_feature: 55413.44.23.C01.1.pb.heavy.1.raw 55413
cgtatcgcctcctcgcgccatcagacagtatatacacgaccggtgctcgatttagtacacgtgattagggattgggggctttctgagagtcaaggactcctgtgcaagaacatgaagcacctgtggtttttcctcctgctggtggcagctcccagaatgggtcctgtcccaggtgccagctgcaggagtcgggcccaggactggtgaggccttcggaaccctgtctctcatctgcactgtctctggagtttccatcagttctgatcattcttggggctggatccgcagcccccagggaggggaatggagtggattggtgacatccattatactgggggcgaccgtactactctccgtccctcaaggagtcgtctcaccatttcgagggacacgtccatgaacccgcttctcctgaaaactgacctccgtggaccgcccgcggacacggccgtttatttctgtgcgaggcgagactggtctttcaatctatgggccgtggcacccctggtcactgtcctcctcagcttccaccaagggcccatccgtcttccccctggcgccctgctccaggagcacctctgggggcacagcggccctgggctgcctggtcaaggactactttccctatatacctgtctgagcgggctggccaaggcgcatag

SEQ ID NO: 792592 - DNA, 664 bp, Homo sapiens
  misc_feature: 55433.44.86.H09.1.pb.heavy.1.raw 55433
ctatgcgccttgccagcccgctcagacagtatataggaagtagtccttgaccaggcagcccagggccgctgtggcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcgcctcgaaatggtgagacgactcttgagggacggagagtagtacgtcgccccagtataatggatgtcaccaatccactccattccccctccctggggctgccggatccagccccaagaatgatcagaactgatggaaactccagagacagtgcagatgagagacagggttcccgaaggccctcaccagtcctgggcgccgactcctgcagctgcacctgggacaggacccatctgggaggctggcaccagcaggaggaaaaaccaccaggtgccttcatgttcttgcacaggagggtccttgactctcagaaagcatcccaaacccaagtctatagcactaaatcgagcaccggtcgtgtatatactgtctgatggcgcgcgagggaggcgatacg

SEQ ID NO: 792593 - DNA, 687 bp, Homo sapiens
  misc_feature: 55435.44.72.G06.1.pb.heavy.1.raw 55435
cgtatcgcctccctgcgcgccatcagacagtatatacacgaccggtgctcgatttagctacgactgcaagggaaagggggagaggaccttagccctgactccaaggcctttccacttggtgatcagcactggcacagaggactcaccatggaattggactgagctgggttttccttgttgctattttagaaggtgtccagtgtgaggtgcaactggtggagtctggggggaggcttggtccagcctgggggtccctgagactctcctgtgcagcctctggattcacctttagtagttattggatgaactgggtccgccaggctccagggaaggggctggagtgggtggccatcatgaagaagatggaactgagacacactatgtggactctgtgaaggggccgattcaccatctcaggacaacgccaagaactcactgtatctgcaaatgaacagtctgagagtcgaggacacggctgtgtatttattgtgcggaggcgctgggtggctcatttgactactggggtcagggaaccctggtcaccgtctcctcagcctccaccaagggcccatcggtcttcccctggcgccctgctccagagcacctccgagagcacagcggcccctgggctgcctggtcaagactacttcctatatactgtctgagccgggctggcaaggcgcatag

SEQ ID NO: 792594 - DNA, 607 bp, Homo sapiens
  misc_feature: 55440.UNK.UNK.UNK.pb.heavy.1.raw 55440
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatgcttgcaacgccactcgtaaaactagtactttgcggttaggggaagtagacaaaacccattactccacttccggaagttcaactcattccaacacgaaataaaagtaaactcaacaccccaagcaggctatgtggggggtgataggggtggattctatttctatcccatcccctaggatctcattaagttactagcgagttaaatgtctggtagcgatcccgtcagtcctatcgcgccgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtggtcggg

SEQ ID NO: 792595 - DNA, 707 bp, Homo sapiens
  misc_feature: 55444.44.27.C05.1.pb.heavy.1.raw 55444
cgtatcgccctcctcgcggcatcagacagtatatacacgaccggtgctcgattagacgcgatcgaagggtttggggcctgggagacgagccagcactgaagtcgccggtgtttccactcggtgatcatcactgaacacagcagaggactcaccatggagtttgggctgagctgggttttcctcgttgccctcttaagaggtgtcatgtgtcaggtgcaatcgtggagtctgcggaggcgtgcgcgcccagtaggcggggtccctgagactctcctgtgcagcctctggattcaccttcgataattggaatatgcaggtggtccgccaggctccaggcgagggctggagtgggtggcaggtgtgtcatttcatggaggaaatcaagtctacgcggtgattccgttgaggcgccgattcaccatctccagagacaattccgagaacacagtgtctcttcaaatgaacagcctgagacctcaggacacggccgtgtatttttgtgcggagactatctgtttccaaatcgcgttcattcgacgcctggggccagggaaccctgtcaccgtctcctcggcctccccaaggcccatcgcgtcttccccctggcgccctgctccaggagcacctccgagagcacagcggccctgggctgcctggtcaaggactacttccctatatactggtctgagcgggctggcaggcgcatg

SEQ ID NO: 792596 - DNA, 588 bp, Homo sapiens
  misc_feature: 55445.44.78.H01.1.pb.heavy.1.raw 55445
cgtatcgcctccctcgcgccatcagacagtatatacacgaccggtgctcgatttagtgtgagtagttgggtttggggggaagagaaagactgacggtccactcccaggtacagctgtgcagtctggggctgaggtgaagaagcctgggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctccctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 792597 - DNA, 718 bp, Homo sapiens
  misc_feature: 55458.44.36.D03.1.pb.heavy.1.raw 55458
cgtatcgcctccctcgcgccatcagacagtatatacacgaccggtgctcgatttagctgcgtcacgatctctcttgggagcttctcagagaggtgccttagccctggattccaaggcatttccacttggtgatcagcactgaacacagaggactcaccatggagtttggggctgcgctgggtttttccttgttgctattttagaaggtggtccactgtgaggtgcggctggtgggagtctgggggaggcttggtacagcgggggggggtccctgagactctcctgtgcagcctcttggattcatcttcagtgactatgccatgaactgggttccgccaggctccaggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttgtcagtggctggttttgactactggggccggggaaccctggtcaccgtctcctcagcctccaccaagggcccatcggtcttccccctggcgccctgctccaggagcacctccgagagcacagcggccctgggctgcctggtcaaaggactacttcctatatactgtctgagcggctggcaaggcgcatag

SEQ ID NO: 792598 - DNA, 601 bp, Homo sapiens
  misc_feature: 55464.UNK.UNK.UNK.pb.heavy.1.raw 55464
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgatagactgacgggatcgctacagacatttaactcgctagtaacttaattgagatcctaggggatgggataggaaatagaatccaccctatcaccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccagatggcgctagcgggttccgcagcttttgacctggaccagggtgcatagcctgcccagccttc

SEQ ID NO: 792599 - DNA, 695 bp, Homo sapiens
  misc_feature: 55466.UNK.UNK.UNK.pb.heavy.1.raw 55466
ctatgcgccttgccagcccgctcagacagtatataggaagtagtccttgaccaggcagcccagggccgctgtgcccccaggaggtgctcttggagagagggtgccagggggaagaccgatgggcccttggtggagggctgaggagacggtgaccagggttccctgcgcccagggtcgagccagttcgccccccccgtctctactggtatcgataggaaatcctctcgcacaataatatacggccgtgtccgcggcggtcacagaagtcaattcagggagaactgggttcttggacctgtctagtgacatggtgactcactcttgagcggggtttgtagttggtgctgcccactgttataagtgcgcccaatccactccagtcccttcccgggccggactgccggcagccagctccaataataactactgatgtaaccaccagagacattgcaaggtgagggacagggtctccgaaggcttcaccgtcctgggcccgactcctgcagctgcaccctcggacacgacccatctgggagggtgccaccaggaggaggaaagaacccacagggtgtttcatgttcttgtgccagggaaggcccatgagtctcagaaagtatccccaaaccaactatcgtgtgctaaatcgagcacggtcgtgtatatactggtctgatggcgcgaagggaggcgatacg

SEQ ID NO: 792600 - DNA, 666 bp, Homo sapiens
  misc_feature: 55480.44.57.F02.1.pb.heavy.1.raw 55480
cgtatcgcctccctcgccgccatccagacagtatatacacgaccggtgctcgatttagctcgatatagttgggtttgggaatgctttctgagagtcaaggacctcctgtgcaagaacatgaagcacctgtggtttttcctcctgctggtggcagctcccagatgggtcctgtcccaggtgcagctttggcaggagtcgggcccaggactggtgaggccttcgggaaccctgtctctcatctgcactgtctctggagtttccatcagttctgatcattcttggggctggatccggcagcccccaggggaggggaaatgggtggattggtgacatccattatactgggggcgaccgtactacctctccgtccctcaagagtcgtctcaccatttcgagggaacacgtccatgaaccgcttctccctgaaactgacctccgtgaccgccgcggacacgggccgtttatttctgtgcgaggcgagactggtctttcaatctatggggccgtggcaccctggtcactgtctcctcagcttccaccaagggtccatcggtcttccccctggcgccctgctccaggagcacctctggggggcacagcggcctgggctgcctggtcaaggactacttcctatatactgtctgagcgggctggcaaggcgcatag

SEQ ID NO: 792601 - DNA, 633 bp, Homo sapiens
  misc_feature: 55512.44.86.H09.1.pb.heavy.1.raw 55512
cgtatcgcctccctcgcgccatcagtctatactatcacgaccggtgctcgatttagtgctatagacttgggtttgggatgctttctgagagtcaaggacctctgtgcaagaacatgaagcactgtggtttttcctcctgctggtggcagctcccagatgggtccctgtccaggtgcagctgcaggagtcgggcccaggactggttgaggcctcgggaaccctgtctctcatctgcactgtcctggagtttccatcagttctgatcattcttggggctggatccggcaggcctaggaggggaatggagtggtggtgacatccattatactggggcgacgtactactctccgtcctcagagtcgtatcaccattcgaggacacgtccattgaaccgctttctcctgaaactgacctccgtgacgccgcggacacggcgtttatttccgtgcgaggcgagactgggtctttatctatgggccgggcaccctggtcactgtctcctgcttccaccaagggccatcggtcttccctggcgccctgctcaggagcacctctgggggcacagcggccctgggctgcctggtcaaggactacttcctatatactgtctgagcgggctggcaaggcgcatag

SEQ ID NO: 792602 - DNA, 600 bp, Homo sapiens
  misc_feature: 55520.UNK.UNK.UNK.pb.heavy.1.raw 55520
ctatgcgcctgccagcccgctcagacgtatataggaagtagtcttgaccaggccagccaggcgctgtgccccagaggtgctcctgggagcagggcgccagggaagaccgatgggcccttggtgaagctgaggagacggtgaccgtggtccctttgcccagacgtccagatggtaagacttataatacagaaaccagctgttttcttcccgcattacccgtgcacagtaatatgtgcctgtgtccgcagggtccatgttggtcatactaaagaccacctgccttttggaggtgtccttggagatggttaaactgcctcttcagagatgtactgtaggaatttttcgtcattcgagaagatgtgtgcagccactccagggccttccctgggggctgacggatccagctcacaccattctaatatcgttgagagagaacccagagatggtgcaggtcagcgtgagggtctctgtgggtttcaccagcaacaggaccagactccttcaaggtgacctgggacaagacccaagagagatcgtgacgcaggctaaaatcagcaaccggtcgtgtatatactgtctgatggcgcgaggagcgatacg

SEQ ID NO: 792603 - DNA, 598 bp, Homo sapiens
  misc_feature: 55522.UNK.UNK.UNK.pb.heavy.1.raw 55522
agaaggctgggcaggctatgcaccctggtccaggtcaaaagctgcggaaccgctagcggccatcttggccactaggggtcccgcagattcatattgtcgtctagcatgcacaatgctgcaaaccagcttgcaatgcccacagcaagcgccaatctttacgccacgttgaattgtttattacctgtgactggctatggcttgcaacgccactcgtaaaactagtactttgcggttagggaaatagacaaaccattactccacttcccggaattcaactcattccaacacgaaataaaagtaaactcacacccaagcaggcatgtggggggtgataggggtggattctatttcctatccatccccctaggatctcaattaagttactagcgagttaaatgtctgtagcgatcccgtcagtcctatcgcgcgcatcaagacctggttgttgagcgtgcagtagatcatcgataagctgcgagttaggtcatcccagaccgcatctggcgcctaaaccgttcagtggtagctaaggcgtcaccttcgacctgtctaagcaatatgtcgtccttagctccaagtccctagcaagcgtgtcggg

SEQ ID NO: 792604 - DNA, 733 bp, Homo sapiens
  misc_feature: 55595.44.33.C11.1.pb.heavy.1.raw 55595
cgtatcgcctccctcgcgcgccatcagacagtatatacacgaccggtgctcgatttagagtgagctcgttgggtttgggagctctgggagaggagcccaagcaccagaagtcggcgggtgtttccagtcggtgatcagcaccgaacacagaggactcaccatggagtttgggctgactgggttttcctcgttgctcttttaagaggtgtcagtgtcaggtgaagctggtggagtctggggaggcgtggtccagcctgggaggtccctgagactctcctgtgtagcgtctggattcaccttcaacagacatgcatgcactgggtccgccaggctccaggcaagggactggagtgggtggcacttatatggtatgatggaagtaaataaatattatgtagattcccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatgggacgcctggggcccaagggaccacggtcgccgtctcctcagcctccaccaagggcccatcggtcttcccctggcaccctcctccaagagcacctctgggggcacagcggcccctgggctgcctggtcaaggactacttcctatatactgtctgagcgggctggcaaggcgcatag

SEQ ID NO: 792605 - DNA, 707 bp, Homo sapiens
  misc_feature: 55608.UNK.UNK.UNK.pb.heavy.1.raw 55608
ctatgcgccttgccagcccgctcagaccagtatactaggaagtagtccttgaccaggccagcccagggccgctgtgctctcggaggtgctcctggagcagggcgccagggggaagaccgatgggccccttggtggaggccgagagacggtgacagggtttccctggccccaggcgtcgaatgaaacgattttgaaacagatagtctcgcacaaaaatacacggccgtgtcctgaggtctcaggctgttcatttgaagagacactgtgttctcgaattgtctctggagatggtgaatcggccctcaacgaatcaccgtagacttgatttcctcccatgaaatgacacacctggcaccaccactccagccctcgcctggagcctggcggacccactgcatattccaattatcgaaggtgaatccagaggcctgcacaggagagtctcagggaccccctactgggccacgcctcccccagactccacgaattgcacctgacacatgacacctcttaagagggcaacgaggaaacccagctcagcccaaactccatggtgagtcctctgtgttcagtgatggatcaccgagtggaaacacggcgacttccagtgcctgggctcgtctcccaggcccaaacccttcgatcgcggtctaaatcgagcaccggtcgtgtatatacttgtctgatggcgcgagggaggcgatacg

SEQ ID NO: 792606 - DNA, 686 bp, Homo sapiens
  misc_feature: 55613.44.78.H01.1.pb.heavy.1.raw 55613
catgcgcccttgccagcccgctcagacagtatataggaagtagtcctgaccaggcagccagggccgctgtgcctcggaggtgctcctggagcagggcgccagggggaagacgatgggcccttggtggggctgaggagacggtgaccagggtccctgcccgaatgaaaccattccagacagtaatagacggctgtgtcctcggtgttcaggctgttcatctgcagagacaccgtatcttttgaatcatctcttgagatggtgaatctgcctttcacgggtgcaggcgtagtcgctgtcccaccgtcagctttggttctaatacggccaacccactccagcccttccctggagcctggcggacccaggtcatccaggcgttactgaaagtgaatccagaggctgcacaggagagtctaagggactcccaggctttaccaaacctccccagactccaccaactgcacctcacactggacaccttttaaaatagcagcaagaaaaatccagctcagcccaaactccatggtgagtcctctgtgttcagtcctgatccactgaatgaaaacacctgggaattcccaaggctggggctctctcccagagctcccccaaaacccaaactactcacactaaatcgagcaccggtcgtgtatatactgtctgatggcgcgaggggaggcgatacg

SEQ ID NO: 792607 - DNA, 678 bp, Homo sapiens
  misc_feature: 55643.44.53.E09.1.pb.heavy.1.raw 55643
ctatgcgcctgccagcccgctcagacagtatatcaggaagtagtccttgaccaggcagcccagggccgctgtgctctcggaggtgctcctggagcagggcgccaggggaagaccgatgggccttggtggaggctgaggagacggtgaccagggttccctggcccgaatgaaaccatccagacagtaatagacggctgtgtcctcggtgttcaggctgttcatctgcagagacaccgtatctttgaatcatctcttgagatggtgaatctgcctttcacgggtgcagcgtagtctgctgtcccaccgtcagctttggttctaatacggccaacccactccagccccttcctggagcctgcgcgaccccaggtcatccaggcgttactgaaagtgaatccagaggctgcacaggagagtctaagggactccccaggctttaccaaacctcccccagactccaccaactgcacctcacacctggacaccttttaaatagcagcaaggaaaatccagctcagcccaaactccatggtgagtcctctgtgttcagtcctgatcactgaatgaaaacacctgggaatcccaaggctgggctcctctcccagagctcaacacactctctctaaatcgagcaccggtcgtgtatatactgtctgatggcgcgagggaggcgatacg

SEQ ID NO: 792608 - DNA, 638 bp, Homo sapiens
  misc_feature: 55653.UNK.UNK.UNK.pb.heavy.1.raw 55653
cgtatcgcctccctcgcgccatcagacagtatatacacgacgggtgctcgatttagtggagtcagtaagggggactcctgtgccccaccatggacacactttgctccacgctcctgctgctgaccatcccttcatgggcctgtcccagatcaccgtgaaagagtctggccctaacattggtgaaacccacacagaccctcacgctgacctgcaccgtctcaggcttctcactcgtcactcctggagagggcgttgtctgggtgcggcagcccccggaaaggccctggagtggatcgcactcacttattggaatgacgatatacgatatagtccttctctgacgaccagactcacgctcacgaaggacacggtccaaaaaaccaggtggtccttacattgaccaacgtggaccctgtggacacagccacatatttctgtgcccacttcatgaccacaatgacccacgggcttcttcgaaccctggggccaggggaatccaggtcaccgtctcatcagcctccaccaaggcccatcggtcttccccctggcgccctgctccaggagcacctccgagagcacagcggccctgggctgcctggtcaaggactacttccctatatactgtctgagcgggctgg

SEQ ID NO: 792609 - DNA, 701 bp, Homo sapiens
  misc_feature: 55656.UNK.UNK.UNK.pb.heavy.1.raw 55656
ctatgcgctttgcagcccgctcagacagtatataggaagtagtccttgaccaggcagccagggccgctgtgcccccagaggtgctctggagcagggcgcaggggaagaccgatgggcccttggtggaagctgaagagacggtgaccattgtccctggccccaaatatcaaatgccatcgacgtcccaggatcgcctggcgcagtaatagacgcctgtgtcgtcgggtctcaggttgctcatttgtaaatggccaacactgttggagtcatcccttgagaacggtgaatcttcccttcacagacgcggcgtactcttttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccgactccgccagtcgccctcgcactggacacttctaaaaaaactacaaggaaatcaagattagcccaaactcatggttggtggtctgttgctcagtgctgatcaccaagtggaaactcctgggatctcacggctgggctcttctccagagctcccttgtgtgttcagagtctgctaaatcgagcaccggtcgtgtatatactgtctgatggcgcgagggaggcgatacg

SEQ ID NO: 792610 - DNA, 702 bp, Homo sapiens
  misc_feature: 55659.44.55.E11.1.pb.heavy.1.raw 55659
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcgacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792611 - DNA, 683 bp, Homo sapiens
  misc_feature: 55686.44.45.E01.1.pb.heavy.1.raw 55686
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 792612 - DNA, 710 bp, Homo sapiens
  misc_feature: 55707.44.36.D03.1.pb.heavy.1.raw 55707
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttttccttgttgttatttttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggggctgagtggcttggccgcagtaaaaacaaagtttgccagctttatcacagagtacgccgcgtctggtgaaagccagattcaccctctcaagagatgacttcaaagaactcattgattctgcgaatgactaaacctgaaaaccgaggacacgggcatgtattattgtgttgtgtttatatcaggaactgtccactggggccagggaaccctggtcaccgtctcctcagcctccaccaagggccatcggtcttcccctggcgccctgctccaggagcacctcccgagagcacagcggccctggctgcctggtcaaggactacttcctatatactgtctgagcgggctggcaaggcggcatag

SEQ ID NO: 792613 - DNA, 695 bp, Homo sapiens
  misc_feature: 55734.UNK.UNK.UNK.pb.heavy.1.raw 55734
ctatggcgcttgccagcccgctcagacagtatatagggaagtattgaccaggcagcccagggccgctgtgccccagaggtgctcttggagggagggtggcccaggggaagaccgatggccttggtggaggcggaggcgacggtgaccagggttccctggccccagaagtcaacgaataataaccactccgagcgccgacttgtctcgcacagtaatagacggccgtgtcgtccgcctctcaggttgttcatttgaagataaccgtgttcctggaattgtccctggagatggtgatcggccttcacggagtctgcgtagtatgtgaaatcaccagtataaatgactgagacccactccagcccttccctggagcctgggcggacccaactcatgtagttgctgctgacggtgagcccagaggctgcacaggagagtctctggacccccaggctggactaagcctctccagactccatcagccgcacctcacactggacacctttaaaagtccaacaaggagaacccagctcagccaaaactccatggtgagtcctctgttgttcagtgctgatcaccgaatggaaacacctcggaatcccagtgctgggctcctctcccccaaaacccaacgtgcgagtgctaaatcgagcaccgtcgtgtatatactgtctgatggcgcgaggcggggcgatacg

SEQ ID NO: 792614 - DNA, 702 bp, Homo sapiens
  misc_feature: 55736.44.27.C05.1.pb.heavy.1.raw 55736
ctatgcgccttgccagcccgctcagacagtatataggagtagtccttgaccaggcagcccagggccgctgtgctctcggaggtgctcctggagcagggcgccaggggaagaccgatgggcccttggtggaggccgaggagacggtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggcacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggcccccaaacccttcgatcgcgtctaaatcgagcaccggtcgtgtatatactgtctgatggcgcgagggaggcgatacg

SEQ ID NO: 792615 - DNA, 675 bp, Homo sapiens
  misc_feature: 55740.44.45.E01.1.pb.heavy.1.raw 55740
cgtatcgcctcctcgcgccatcagacagtatatacacgaccggtgctcgatttagtgagtcagtaagggaaaggggctggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagcgaggactcggctctctattattgtacgagcccatcgttctactgggccagggagccctggtcaccgtctcctcagcctcaccaagggccatcggtcttcccctggcgccctgctccaggagcacctccgagagcacagcggccctgggctgcctggtcaaggactacttcctatatactgtctgagcgggctggcaaggcgcatag

SEQ ID NO: 792616 - DNA, 691 bp, Homo sapiens
  misc_feature: 55772.44.74.G08.1.pb.heavy.1.raw 55772
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctcttttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctggggcaggaacctggtcattgtcacctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 792617 - DNA, 690 bp, Homo sapiens
  misc_feature: 55791.44.27.C05.1.pb.heavy.1.raw 55791
cgtatcgcctcctcgcgccatcagacagtatatacacgaccggtgctcgatttagacgcgatcgaagggtttggggctgggagacgagcccagcactgaagtcgccgtgtttccactcgtgatcatcactgaacacagaggactcacatggagtttgggctgagctgggttttcctcgttgccctcttaagaggtgtcatgtgtcaggtgcaattcgtggagtctggggaggcgtgccccagtagggggtccctgagactctcctgtgcagcctctggattcaccttcgataattggaatatgcagtgggtccgccaggctcaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaatcggttcattcgacgcctgggccagggaaccctggtcaccgtctcctcggcctccaccaagggcccatcggtcttccccctggcgccctgctccaggagcacctccgagagcacagcggccctgggctgcctggtcaaggactacttctatatactgtctgagcgggctggcaaggcgcatag

SEQ ID NO: 792618 - DNA, 705 bp, Homo sapiens
  misc_feature: 55792.44.55.E11.1.pb.heavy.1.raw 55792
cgtatcgcctccctcgcgccatcagacagtatatacacgaccggtgctcgatttagcactcgcacgttgggtttgggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcaccagcggccctgggctgcctggtcaaggactacttcctatatactgtctgagcggctggcaaggcgcatag

SEQ ID NO: 792619 - DNA, 703 bp, Homo sapiens
  misc_feature: 55832.44.36.D03.1.pb.heavy.1.raw 55832
cgtatcgcctccctcgcgccatcagacagtatatacacgaccggtgctcgatttagctgcgtcacgatctctcttgggggagagcggagccccagccccagaattcccaggtgttttcatttggtggatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttccaagaactcattgattctgcgaatgactaacctgaaaaccgaggacacgggcaatgtattatttgtgtgtttatatcaggaactgtccactggggccagggaaccctggtcaccgtctcccctcagcctccaccaagggcccatcggtcttccccctggcgcctgctccaggagcacctccgaggagcacagcggccctgggctgcctggtcaaggactacttcctatatactgtctgagcgggctgcaaggcgcgcatag

SEQ ID NO: 792620 - DNA, 691 bp, Homo sapiens
  misc_feature: 55897.UNK.UNK.UNK.pb.heavy.1.raw 55897
ctatgcgccttgccagcccgctcagaacagtatataggaagtagtccttgaccaggcagcccagggccgctgtgcccccagaggtgctcttggaggagggtgccaggggaagaccgatgggcccttggtgaggcggaggcgacggtgaccagggttccctggcccagaagtcaaacgaataataacaactcgagcgccgactgtctcgcacagtaatagacggccgtgtcgtcgcctctcaggttgttcatttgaagataaacgtgttcctggaattgtccctgagatggtgaatcggcccttcacggagtctgcgtagtatgtgaaatcaccagtataaatgactggagaccactccagcccttccctgagccggcggacccaactcatgtattctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgataccgaatggaaacacctcggaatcccagtgctgggcttcctctccccccaaacccaatattatactctaaatcgagcaccgtcgtgtatatactgctgatggcgcgagggaggcgatacg

SEQ ID NO: 792621 - DNA, 685 bp, Homo sapiens
  misc_feature: 55919.UNK.UNK.UNK.pb.heavy.1.raw 55919
gatcgtatcgcctcctcgcgccatcagacagtatataccacgacggtgctcgattagctgcgtcacgatctctcttggggagagcggagcccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgctctggattcaccatcagtgaccactatatggactgggtccgccaggctccaggaagggctgagtggcttggccgcagtaaaaacaaagtgccagcttatcacagagtacgccgcgtctgtgaagccagattcacccctctcaagagatgacttcaagaactcattgattcgcgaatgataacctgaaaacgaggacacgggcatgtattattgtgttgtgtttatatcaggaactgtccactggggccaggaaccctggtccaccgtctcctcagcctccaccaagggcccatcggtcttcccctggcgcctgctccaggagcacctccgagagcacagcggcgctggctgcctggtcaaggactacttcctatatactgtctgaggcggctggcaaggcgcatag

SEQ ID NO: 792622 - DNA, 672 bp, Homo sapiens
  misc_feature: 55922.UNK.UNK.UNK.pb.heavy.1.raw 55922
ctatgcgccttgccagcccgctcagacagtatataggaagtagtccttgaccaggcagcccagggccgctgtgctctcggaggtgctcctggagcagggcgccagggggaagaccgatgggcccttggggaggctgaggagacggtgaccagggctccctggcccccagtagaacgatgggctcgtacaataatagagagccgagtcctcggctctcaaattgttcatttgtagatacacgtgttcttggaattgtctctggagacggagaatcggcccttcacggagtttccatagtattctttacttccatcagaccagatgactgccacccactccagccccttgcctggagcctggcggacccagtgcatggcaggtcacccgaaactgagtccggagcacacaggagagtctcagggacgtcccaggcggaccacgcctcccccagactccaccagctgaacctgacactgacacctccttaaaagagcaacgaggaaaaccagctcagcccaaactccatggtgagtcctctgtgttcagtgctgatcaccgatgaaacaccgccgactctagtgctgggctctccagcccctttccttactgactccactaaatcgagcaccggtcgtgtatatactgtctgatggcgcggagggaggcgatacg

SEQ ID NO: 792623 - DNA, 703 bp, Homo sapiens
  misc_feature: 55929.UNK.UNK.UNK.pb.heavy.1.raw 55929
ctatgcgccttgccagcccgctcagaccagtatataggaagtagtccttgaccaggcagccagggccgctgtgctctcggaggtgcctcctgagcaggcgccaggggaagaccgatggggcccttggtggaggctgaggagacggtggaccagggttccctggccccagtggacagtttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagcccctccctggagcctggcggacccagtccatatagtggtcactgatgcgtgaatccagaggcgacacaggagagtctcagggaccctccaggctggaccaagtctcccccggactccaccaactgcacttcactctggacaccgttgtaaaataacaacaaggaaaacccagctcagcccgaactccatggtgagtcctctgtgttcagtgctgatcaccaatgaaaacacctgggaattctggggctggggctccgctctcagagctccccagagagatcgtgcgcagctaaatcgagcaccggtcgtgtatatactgtctgatggcgcgaggaggcgatacg

SEQ ID NO: 792624 - DNA, 699 bp, Homo sapiens
  misc_feature: 55937.44.55.E11.1.pb.heavy.1.raw 55937
ctatgcgccttgccagcccgctcagacagtatataggaagtagtccttgaccaggcagcccagggccgctgtgccccagaggtgctcttggaggagggtgccagggggaagaccgatggcccttggtggaggcggaggcgacggtgaccagggttcctggccccagaagtcaaacgaataataaccactccgagcgccgacttgtctcgcacagtaatagacggccgtgtcgtcgcctctcaggttgttcatttgaagataaacgtgtcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctggacccccaggctggactaagcctcctccagagacctccatcagccgcacctcacactggacaccttttaaaagtccaacaaggagaaccagctcagccaaaactccatggtgagtcctctgtgttcagtgctgatcaccgaatggaaacacctcggaatcccagtgctggctcctctcccccccaaacccaacgtgcgagtgctaaatcgagcaccggtcgtgtatatactgtctgatggcgcgagggaggcgatacg

SEQ ID NO: 792625 - DNA, 707 bp, Homo sapiens
  misc_feature: 55955.UNK.UNK.UNK.pb.heavy.1.raw 55955
cgtatcgcctccctcgcgccatcagacagtatatacacgaccgtgctcgatttagcagacgtctgaacacacaaaggggagctctggagaggagccccagccgtgagattcccaggagtttccacttggtgatcagcactgagcacagaccaccaaccatggagtttgggctaatcttgattttccttgtagttttttagaaggtgtcagtgcgagggcgactggcggagtcggggggggggcttggcaaagccagggcggtctctgagactctcctgtgtagtctcaggattcagtcttagtgattatcacttgcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccagggacaatggtcaccgtctcttcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 792626 - DNA, 640 bp, Homo sapiens
  misc_feature: 55987.44.19.B08.1.pb.heavy.1.raw 55987
tgcgccttgccagcccgctcagacagtatataggaagtagtccttgaccaggcagcccagggccgctgtgctctcggaggtgctcctggagcagggcgccaggggaagaccgatgggcccttggtggaggctgatgagacggtgacctggattccctggccccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggcctttccgggggctgccgcacccagacaacgccctctccaggagtgacgagtgagaagcctgagacggtgcaggtcagcgtgagggtctgtgtgggtttcaccaatgtagggccagactctttcacgtgatctgggacaggcccatgaagggatggtcagcagcaggagcgtggagcaaagtgtgtccatggtgggggcacaggagtcccccttactgactcactaaatcgagcaccggtcgtgtatatactgtctgatggcgcgagggaggcgatacg

SEQ ID NO: 792627 - DNA, 702 bp, Homo sapiens
  misc_feature: 56015.44.55.E11.1.pb.heavy.1.raw 56015
ctatgcgccttgccagcccgctcagacagtatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactcgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagaagtctctgggaccccccaggctggactaagcctcctccagactccatcagccgcacctcacactggacaccttttaaagtccaacaaggagaacccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgagggaggcgatacg

SEQ ID NO: 792628 - DNA, 704 bp, Homo sapiens
  misc_feature: 56027.44.53.E09.1.pb.heavy.1.raw 56027
cgtatcgcctccctcgcgccatcagaacagtatatacacgaccggtgctcgatttagagagagtgtgttgagctctgggagaggagccccagcctggattcccaggtgttttcattcagtgatcaggactgaacacagagactcaccatggagtttgggctgagctggattttccttgctgctattttaaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggcgctggagtgggttggccgtattagaaccaaagctgacggtgggacagcagactacgctgcacccgtgaaaggccagattcaccgaatctcaagagatgattcaacaagatacggtgtctcctgccagatgaacagcctgaacaccgaggacacagccgtctattactgtctggatggtttcattcgggccagggaaccctgcgtcaccggtctcctcagcctccaccaagtgccccatcggcttcccccgctggcgcccgctggcggcaggacgccacctccgagagcacagcggcccgctgggctgcctggtcaagggactacttcctatatactgttctgagcgggctggcaaggcgcgcatag

SEQ ID NO: 792629 - DNA, 695 bp, Homo sapiens
  misc_feature: 56060.UNK.UNK.UNK.pb.heavy.1.raw 56060
ctatgcgccttgccagcccgctcagacagtatataggaagtagtcttgaccaggcagcccagggccgctgtgcccccagaggtgctcttggaggaggcgtgccagggggaagaccgatggcccttggtggaggcggaggcgacggtgaccagggttccctggcccagaagtcaaacgaataataaccactcgagcgccgacttgtctcgcacagtaatagacggccgtgtcgtcgcctctcaggttgtcatttgaagataaaccgtgttcctggaattgtccctggagatggtgaatcggcccttcacggagtctgcgtagtatgtgaaatcaccagtataaatgactgagacccactccagccccttcctggagcctggcgacccaactcatgtagttgctgctgacggtgagcccagaggctgcacaggagagtctctggaccccccaggctggactaagcctcctccagactcatcagccgcacctcacactggacaccttttaaaagtcaacaaggagaacccagctcagcaaaactccatggtgagtcctctgtgttcagtgctgatcaccgaatggaaacacctcggaatcccagtgctgggctcctctcccccccaaacccaacgtgcgagtgctaaatcgagcacgtcgtgtatatactcgtctgatggcgcgagggaggcgatacg

SEQ ID NO: 792630 - DNA, 712 bp, Homo sapiens
  misc_feature: 56074.44.56.F01.1.pb.heavy.1.raw 56074
ctatgcgccttgccagcccgctcagacagtatataggaagtagtccttgaccaggcagccagggccgctgtgccccagaggtgctcctggagcagggcgccagggggaagaccgatgggcccttggtggaagctgaagagacggtgaccattgtcccctggccccaaatatcaaatgcatcgacgtccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgccctcgcactggacaccttctaaaaaaaactacaaggaaaatcaagattagcccaaactccatggttggtggtctgtgctcagtgctgatcaccaagtggaaactcctgggaatctcacggctggggctcctctccagagctcccctttgtgtgttcagacgtctgctaaatcgagcaccggtcgtgtataatactgtctgatggcgcgagggaggcgatacg

SEQ ID NO: 792631 - DNA, 604 bp, Homo sapiens
  misc_feature: 56087.UNK.UNK.UNK.pb.heavy.1.raw 56087
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccaccctatcacccccccacatagcctgcttggggtgttgagtttacttttatttcgtgttggaatgagttgaacttccgggaagtgagtaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagcttttgacctggaccagggtgcatagcctgcccagccttc

SEQ ID NO: 792632 - DNA, 697 bp, Homo sapiens
  misc_feature: 56102.44.36.D03.1.pb.heavy.1.raw 56102
cgtatcgcctccctcgcgcgccatcagacagtatatacacgaccggtgctcgatttagctgcgtcacgatctctcttgggggagagcggagccccagccccagaattcccaggtgttttcatttggtgatcagcactgaacacagagggactcaccatggagttcgggctgagctgggttttccttgttgttattttacaggtgtccagagtgaagtgcagttggtggagtccgggggagacttgtccagcctggagggtcctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaaatgactaacctgaaaaccgaggacacgggcatgtattattgtgttgtgtttatatcaggaactgtccactggggccagggaacctggtcaccgtctccctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 792633 - DNA, 702 bp, Homo sapiens
  misc_feature: 56150.44.73.G07.1.pb.heavy.1.raw 56150
ctatgcgcctgccagcccgctcagacagtatataggaagtagtccttgaccaggcagcccagggccgctgtgctctcggaggtgctcctggagcagggcgccagggggaagaccgatgggcccttggtggaggctgaggagacgggaaccagtgtcccctggccccagtgaaaacgcccgataatagctgctgccacttcccgatctcgcacagtaatacagagccgagtcctcgcctctcaggctgatcatttccaggtacagagtgttccgggaattgttctctggagatggtgaatcggcccttcacggagtctgcataatatctagaagttccatcatatgctataactgccaaccactcggccccttgcctgagcctggcggacccagtgcatgccagaaactactgaaactaaatccagaggcttcacaggagagtctcagggacctcccaggctggaccacgcctccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatgcgcgaggaggcgatacg

SEQ ID NO: 792634 - DNA, 696 bp, Homo sapiens
  misc_feature: 56252.44.67.G01.1.pb.heavy.1.raw 56252
cgtatcgcctccctcgcgccatcagacagtatatacacgaccggtgctcgattagagtatacatattgggtttgggggggagaggagcccagcactgggattccgaggtgtttccattcggtgatcagcactgaacacagaggactcacatggagttttggctgagctgggttctccttgttggacttttaaaaggtgtccagtgtgaggtgcggctgatggagtctgaggaggcttagtccagcctggggggtccagagactctcctgtgcagcctctggctcaccgtccagcagcaactacatgagttgggtcccgccaggctccaggaaggggctgagtgggtctcagtcatttatactggtgatttcacatactacgcagactccgtgaagggccgattcaccatctccagggacaattccaggaacacgggtttatcttcaatgaacaacctgagaggcgacgacacggccgtctattactgtgcgagacaagtcgcgctcggagtgttattattcgtttgacttctggggccagggaacctggtcaccgtcgcctccgcctccaccaagggcccatcgtcttcccctggcacctcctccaagagcacctctgggggcacagcggccctgggctgcctggtcaaggactacttccctatatactgtctgagcgggctggcaaggcgcatag

SEQ ID NO: 792635 - DNA, 653 bp, Homo sapiens
  misc_feature: 56253.44.23.C01.1.pb.heavy.1.raw 56253
ctatgcgccttgccagcccgctcagacagtatataggaagtagtccttgaccaggcagcccagggccgctgtgcccccagaggtgctcctggagcagggcgcccaggggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtccgccccagtataatggatgtcaccaatccactccattcccctccctggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatattactgtctgatggcgcgaggaggcgatacg

SEQ ID NO: 792636 - DNA, 679 bp, Homo sapiens
  misc_feature: 56284.44.53.E09.1.pb.heavy.1.raw 56284
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtgggtggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcgtcttccccctggcgccctgctccaggagcacctccgagagcacagcggccctggctgcctggtcaaggactacttcctatatactgtctgagcgggctggcaaggcgcatag

SEQ ID NO: 792637 - DNA, 754 bp, Homo sapiens
  misc_feature: 56285.UNK.UNK.UNK.pb.heavy.1.raw 56285
tcgtatcgccctccctcgcgccatcatggagacagtatatacaccgcaccggtgctcgatttagcactcgcacgttgggtttggggagaggagcccaggcactgggattccgaggtgtttccattcggtgatcagcactgaacacagaggactcaccatggagttttggctgagctgggttctccttgttggactttttaaaagggtgtccaggtgtgaggtgcggcgctgatgggagtctggaggaggcttagtccagcctgggggggtcccagagactctcctgtgcagcctctgggctcaccgtcagcccagcaactacatggagttgggtccgccggcaggctccgcagggaaggggctggagtgggttctcagtcaatttatactgtgatttcacatactacgcagactccgtgagagggcccgattcaccatctccaggggacattccaggaacacggtttatcttcaaatgaacagacctgagagggcgacgacacgggccgtctattactgtggcgagacaagtcggcgctcggagtggttattattcgtttgacttctggggccagggaaccctggtcaccgtcgcctccgccttccaccagggccatcggtcttcccccttggccaccctcctccaagagcacctctgggcggcacagcccccggcctgggctagcgcggcccctgctggtcaaggaatctacttcctatatacggtctctgagcggctggcaaggccgcatag

SEQ ID NO: 792638 - DNA, 677 bp, Homo sapiens
  misc_feature: 56286.44.35.D02.1.pb.heavy.1.raw 56286
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaacccgccctcaagagtcgagtcaccatgtcactagacaggtccaagaaccagttctccctgaaattgacttctgtgaccgccgcggaacacggccgtatattattgtgcgagagattcctatcgatacagtagagacgggggggcgaactggctcgacccctggggccagggaaccctggtcaccgtctcctcagcctccaccaagggcccatcggtcttccccctgcaccctcctccaagagcacctctggggcacagcggccctgggctgcctggtcaaggactacttcctatatactgtctgagcgggctggcaaggcgcatag

SEQ ID NO: 792639 - DNA, 675 bp, Homo sapiens
  misc_feature: 56293.44.36.D03.1.pb.heavy.1.raw 56293
ctatgcgccttgccagcccgctcagacagtatataggaagtagtccttgaccaggcagcccagggccgctgtgctctcggaggtgctcctggagcagggcgccaggggagaccgatgggccttggtggaggctgaggagacggtgaccagggttcctggccccagtggacagttcctgatataacacacaaataacatgcccgtgtcctcggttttcaggttagtcattcgcagaatcaagagttcttgaagtcatctcttgagagggtgatctggctttacagacgcggcgtactctgtgataaagctggcaacttgtttttctgcggccagccactccagcccttccctggagcctggcggacccagtccattagtggtcactgatggtgaatccagaggcgacacaggagagtctcagggaccctccaggctggaccaagtctccccggactccaccaactgcacttcctctggacacctgtaaaaaacaacaggaaaaccagctcagcccgaactccatggtgagtcctctgtgtcagtgctgatcaccaatgaaaacacctggattctgggctggggctccgctctcagagctccccaagagagatcgtgacgcagctaatcgagcaccggtcgtgatatactgtctgatggcgccgagggaggcgaacg

SEQ ID NO: 792640 - DNA, 710 bp, Homo sapiens
  misc_feature: 56300.44.36.D03.1.pb.heavy.1.raw 56300
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctgcccccagtggacagtttcctgattataaacacaacacaataatacatgccccgtgtcctcggttttcaggttagtcattcgcagaatcaatgagttcttgaagtcatctcttgagagggtgaatctggctttcacagacgcggccgtactctgtgataaagctggcaactttgtttttactgcggccaagccacttccagccccttccctggaggcctggcggacccagtccatatagtggtcactgatggtgaaatccagaggcgacacaggagagtctcagggaccctccaggctggaccaagtctccccggactccaccaactgcacttcactctggacaccttgtaaaataacaacaaggaaaacccagcctcagcccgaactccatggtgagtcctctgtgttcagtgctgatcacaaatgaaaacacctgggaattctggggctggggctccgctctcagagctccccaagagagatcgtgacgcagctaaatcgagcaccggtcgtgtatatactgtctgatggcgcgaggaggcgatacg

SEQ ID NO: 792641 - DNA, 733 bp, Homo sapiens
  misc_feature: 56327.UNK.UNK.UNK.pb.heavy.1.raw 56327
cgtatcgcctccctcgccgccatcagacagtatataccacgaccgcgtgctccgattttagcactcgcaccgttggggtttgggggggggggagaggagcccagcactggggattccgaagtgtttcattcggtgatcagcactgaaccacagaggactcaccatggagtttttggctgagctgggttctccttgttggacttttaaaaaaggtgtccagtgtcgaggtgggcggctgatggagtctggaggaggcttagtccagcctgggggggtcccagagactctcctgtgcaggcctctgggctcaccgtccagcagcaactacatgagttgggtcccgccaggctccagggaaggggctggagtgggtctcagtcatttattacttggtgatttcacatactacgctgactccgtgaaggggccgattcaccatctccagggacaattccgaggaacacgatttatcttcaaatgaacaacctgagaggcgacgacacggccgtctattactgtgcgagacaagtcggcgctcggagtggttattattcgtttgacttctggggccagggaaccctggtcaccgtcgcctccggcctccaccaagggcccatcggtcttccccctggcaccctcctccaagagcacctctggggcacagcggccctgggctggcctggtcaagactacttcctatatactgtctgagcgggctggcaaaggcgcatag

SEQ ID NO: 792642 - DNA, 625 bp, Homo sapiens
  misc_feature: 56329.UNK.UNK.UNK.pb.heavy.1.raw 56329
cccgacacgccttgctagggacttggagctaaggacgacatattgcctttagacagtcgaaggtgacggccttagctaccactgaacgtttaggcgccagaatgcggtctgggatgacctaactcgcagcttatcgatgatgctactgcacgctcaaccaaccagggtcttgatgcgcgcgataggactgacgggatcgctacagacatttaactcgctagtaacttaattgagatcctagggggatggataggaaatagaatccacccctattcaccccccccccacatagcctgcttggggtgttgagtttaccttttattcgtgttggaatgagttgaacttccgggaagtggagtaatgggtttgtctacggttccctaaccgcaaagtactagttttacgagtgggcgttgcaagcatagccagtcacaggtaataaaacaattcaacgtggccgtaaagattggccgcttgctgtgggcattgcaagctgggtttgcagcattgtgcatgctagacgacaatatggaatctgcgggacccctagtggcgcaagatggccgctagccggttccgcagcttttgacctggaccgccagggtgcatagcctgcccagccttc

SEQ ID NO: 792643 - DNA, 714 bp, Homo sapiens
  misc_feature: 56331.44.36.D03.1.pb.heavy.1.raw 56331
cgtatcgcctccctcgcgccatcagacagtatatacacgaccggtgctcgatttagctgcgtcacgatctctctttggggagctctgagagcggagccccagccccagaattcccaggtgtttttcatttggtgatccagcactgaacacagaggactcaccatggagttcgggctgagctgggtttttccttgttgttattttacaaggtgtccagagtgaagtgccagttggtggagtccgggggagacttggtccagcctgggagggtccctgagactctcctgtgtcgcctctgggattcaccatcagtggaccactatatggactgggtccgccaggctccagggaaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792644 - DNA, 725 bp, Homo sapiens
  misc_feature: 56366.44.85.H08.1.pb.heavy.1.raw 56366
ctatgcgccttgccagcccgctcagacagtatataggaagtagtccttgaccaggcagcccagggccgctgtgccccccagaggtgctcttggaggagggtgccagggggaagaccgatgggccctggtggaggctgaggagacggtgaccgtggtcccttggccccagacgtccataccgtagtagtagtcccagcaggtggtagtactacaatatgtcctcgccacagtaatacacagcccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggacacgcctcccccagactccaccagctgcacctgacactggacacctcttaaaagagcaacgaggaaaaccccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 792645 - DNA, 692 bp, Homo sapiens
  misc_feature: 56370.44.73.G07.1.pb.heavy.1.raw 56370
ctatgcgccttgccagcccgctcagacagtatataggagtagtccttgaccaggcagcccagggccgctgtgctctcgaggtgctcctggagcaggcgccaggggaagaccgatgggccttggtggaggctgaggagacggtgaccagtgtccctggcccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgcaaccactcggccccttgcctggagcctgggcggaccagtgcatgccagaactactgaaactaaatccagaggcttcacaggagagtctcaggacctcccaggctggaccacgcctccccagactccacaggtgcacctgacactggacacctcttaaaagagtaacgaggaaaacccagctcagcccaaactccattgtgagtcctctgtgttcagtgctgatcaccgaatggaaacaccgccgacttctagtgctggctcctctcccagagctcccctgagcgtagagctaaatcgagcaccggtcgtgtatatactgtctgatggcgcgagggaggcgatacg

SEQ ID NO: 792646 - DNA, 667 bp, Homo sapiens
  misc_feature: 56374.44.71.G05.1.pb.heavy.1.raw 56374
cgtatcgcctcccctcgcgccatcagacagtatatacacgaccggtgctcgatttagtgtcgtcgcaagagagaggagcccagccctgggactgaacagagagaactcaccatggagtttggctgagctggctttttcttgtggctgtttaaaaggtgtccagtgtgaagtgcagctgttggagtcggggggaggcttggtacagccgggggggtccctgacactctcctgtgcagcctctggattcgcctttaatacctatgccatgatctgggtccgtcaggccccagggaagggctggagtgggtctcatccattactgggtggtagtgccacaaatgtcgcagactccgtgaagggcccgcttcatcgtctccaggacaattccaagaatacgtgtttctgcagatgaagagcctgcgagtggacgacacggccctttattactgtgccagaggtcgcagaagttacaacaatacaagtattactactacatggacgtctggggcaaagggaccccggtcaccgttcctcagcctccaccaagggccatcggtcttccccctggcaccctcctccaagagcactctggggcacagcggccctggctgcctggtcaaggactacttcctatatactgtctgagccgggctggcaaggcgcatag

SEQ ID NO: 792647 - DNA, 694 bp, Homo sapiens
  misc_feature: 56392.UNK.UNK.UNK.pb.heavy.1.raw 56392
cgtatcgcctccctcgcgccatcagacagtatatcacgacggtgctcgatttagcactcgcacgttgggtttgggggggagaggagcccagcactgggattcgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctggctcaccgtcagcagcaactacatgagttggtccgccaggctccagggaagggctggagtggtctcagtcatttatactggtgatttcacatactacgcagactccgtgaagggccgattcaccatctccagggacaattcaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggccatcggtcttcccctggcaccctcctccaagagcacctctgggggcacagcggccctgggctgcctggtcaaggactacttcctatatactgtctgagcgggctggcaaggcgcatag

SEQ ID NO: 792648 - DNA, 595 bp, Homo sapiens
  misc_feature: 56393.UNK.UNK.UNK.pb.heavy.1.raw 56393
cgtatcgcctccctcgcgccatcagacagtatatacacgacggtgctcgatttagctgcgtcacgatctctcttgggtcttgtcccaggtcaccttgaaggagtctggtctgtgctggtgaaacccacagagaccctcacgctgacctgcaccatctctgggttctctctcaacgatattagaatgggtgtgagctggatccgtcagcccccaggaaggccctggagtggcttgcacacatcttctcgaatgacgaaaaatcctacagtacatctctgaagagcagtttaaccatctccaaggacacctccaaaagcaggtgtctttagtatgaccaacatggacctgcggacacagcacatattactgtgcacgggtaatgcgggaaagaaacagctggtttctgtattataagtcttaccatctggacgtctggggcaaaggaccacggtcaccgtctcctcagcttccaccaagggccatcggtcttcccctggcgccctgctccaggagcactctggggcacagcggccctggctgcctggtcaaggactacttcctatatactgtctgagcgggctggcaaggcgcatag

SEQ ID NO: 792649 - DNA, 703 bp, Homo sapiens
  misc_feature: 56409.UNK.UNK.UNK.pb.heavy.1.raw 56409
ctatgcgccttgccagcccgctcagacagtatataggaagtagtccttgaccaggcagcccagggccgctgtgctctcggaggtgctcctggagcagggcgccaggggaagaccgatgggcccttggtggaggctgagagacggtcaccactgtccccggccccaagtactaaaggtgtcatggggggtcaccgtggtcctggctttcaaacagtaatagacgcctgtgtctcgggtctcaggttttcatttggagaaacaatttgtcctgcgaattgtcccctggaaatggtgaagcggcccttcacggatctccgtagaaagtgacacaccagctccgatacttgagacccactccagtcccctccctggagcccggcggacccaggtcatgccataggcactaaggtgaatccagagggccgcacaggagagggtcagggacctcccaggccgaatcaggcccccccagactccaacaactgcacttcacacacgacacccttaaaaaagccacaagaaaaagcagctcagccccaaactccatggagactttctctctgttcggtcctggtcaccaaatgaagacacctggaaaatccagggctgggctcctctctcagagctcccctttcccttatgcgactactaaatcgagcaccgtcgtgtatatactgtctgatggcgcgagggaggcgatacg

SEQ ID NO: 792650 - DNA, 689 bp, Homo sapiens
  misc_feature: 56428.44.36.D03.1.pb.heavy.1.raw 56428
cgtatcgcctcctcgcgccatcagacagtatatacacgaccggtgctcgatttagctgcgtcacgatctctcttgggagctctgagagcggagcccagccccagaattccaggtgttttcatttggtgatcagcactgaacacagaggactcaccatggagttcgggctgagctgggttttccttgttgttattttacaaggtgtccagagtgaagtgcagttggtggagtccggggagacttggtccagcctggaggtccctgagactctctgtgtcgcctctggattcaccatcagtgaccactatatggactgggtcgccaggctccagggaaggggctgagtggcttggccgcagtaaaaacaaagttgccagcttatcacagagtacgccgcgtctgtgaaagcagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccagggccatcggtcttcccctggcgccctgctccaggagcacctccgaggcacagcggcctgggctgcctggtcaaggactacttcctatatactgtctgagcgggctggcaaggcgcatag

SEQ ID NO: 792651 - DNA, 621 bp, Homo sapiens
  misc_feature: 56453.UNK.UNK.UNK.pb.heavy.1.raw 56453
cccgacacgcttgctagggactttggagctaaaggacgacatattgcctttagacaagtcgaaggtgacgccttagctaccactgaacgtttaggcgccagatgcggtctgggatgacctaactcgcagcttatcgatgatctatgctacgctcaaccaaccaggtctttgatgcgcgcgatagatacgggatcgctacagacatttaactcgctagtaacttaattgagatcctaggggatgggaataggaatagaatccaccccctatcaccccgcaactcccatagcctgcttggggtgttgagtttactttcttatttcgtgttgggaatgagttgaacttccggagagtggagtaatgggtttgtctacttcccctacgcaaaaagtcactagttttacgagtggcgttgcaagccatagccaggtcacagtaatacacaattcaacgtggcgtaaagattggccgcttgctgtgggcattgcagcctgggtttggcagcatgtgcatgctagacgacaatatgaatctgcggacccccctagtggccaagatgggccgctagcgggttccgcagcttttgacctggaccaggggtgcatagcctgcccagccttc

SEQ ID NO: 792652 - DNA, 651 bp, Homo sapiens
  misc_feature: 56463.44.86.H09.1.pb.heavy.1.raw 56463
cgtatcgcctccctcgcgccatcagacagtatatacacgaccggtgctcgatttagtgctatagacttggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggcgtttatttctgtgcgagcgagactggtctttcaatttatggggccgtggcacccctggtcactgtctcctcagcttccaccaagggcccatcggtcttccccctggcgccctgctccaggagcacctctgggggcacagcggccctgggctgcctggtcaaggactacttccttatactgtctgagcgggctggcaaggcgcaatag

SEQ ID NO: 792653 - DNA, 656 bp, Homo sapiens
  misc_feature: 56495.UNK.UNK.UNK.pb.heavy.1.raw 56495
ctatgcgccttgccagcccgctcagaacagtatataggaagtagtccttgaccaggcagcccagggccgctgtgccccagaggtgctcctggagcagggcgccaggggaagaccgatgggcccttgtggaagctgaggagacagtgaccagggtgccacgccccatagattgaaagaccaagtctcgcctcgcacagaaataaacgccgtgtcgcggcggtcacggaggtcagtttcagggagaagcggttcatggacgtgtccctcgaaatggtgagacgactcttgagggacggagagtagtacgtcgccccagtataatggatgtcaccaatccactcattcccctccctgggggctgccggatccagccccaaagaatgatcagaactgatggaaactccagagaccagtgcagatgagagacagggttcccgaaggcctcacagtcctgggcccgactcctgcagctgcacctgggacaggacccatcctgggagctgccaccagcaggaggaaaaaccacaggtgcttcatgtttcttgcacaggaggtccttgactctcagaaaagccccccaatccctaatcacgtgtactaaatcgaggcaccggtcgtgtatatactgtctgatggccgcgagggagggcgatacg

SEQ ID NO: 792654 - DNA, 695 bp, Homo sapiens
  misc_feature: 56507.UNK.UNK.UNK.pb.heavy.1.raw 56507
ctatgcgccttgccagcccgctcagacagtatataggaagtagtccttgaccaggcagcccagggccgctgtgccccccagaggtgctcttggaggagggtgccaggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactgacaccttttaaaagtccaacaaggagaacccagctcagccaaactccatggtgagtcctctgtgttcagtgctgatcaccgaatggaaacacctcggaatccagtgctgggccctctcccccaaacccaatatgtatactctaatcgagcaccgtcgtgtatatactgtctgatgcgcgagggaggcgatacg

SEQ ID NO: 792655 - DNA, 663 bp, Homo sapiens
  misc_feature: 56515.44.12.B01.1.pb.heavy.1.raw 56515
ctatgcgccttgccagcccgctcagacagtatataggaagtagtccttgaccaggcagcccagggccgctgtgccccagaggtgctcttggggagggtgccagggggaagaccgatgggcccttggtggaggctgaggagaacgtgaccagggttccctggcccagtggtcaaagtagttggtgacgaactgccctactctcgcacagtaatacacggccgtgtccgcggcggtcacagagctcagcttcagggagaaactgttcttggacgtgtctacgatatgggactcgactcttgagggacgggtgtagtaggtgctccccactataatagatactcccaatccactccagccccttccctgggggctggcggatccagccccagtagtaactactactgctgatggagcccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttctttgcacaggaggtccatgactctcagaaagcccccgcggaatctacactactaaatcgagcaccggtcgtgtatatactgtctgatggcgcgagggaggcgattacg

SEQ ID NO: 792656 - DNA, 723 bp, Homo sapiens
  misc_feature: 56534.44.85.H08.1.pb.heavy.1.raw 56534
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatgggagtttgggctgagctgggtttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaagggctggagtgggtggcacttatatggtatggatggaagtaataaatactatgcagactccgtgaaagggccgattcaccatctccagagacaattccaagaacacgctgtatctgcaaatgacagcctgagagccgaggacacggcctgtgtattactgtgcgaggacatattgtagtactaccacctgctgggactactactacggtatggacgtctggggccaagggaccacggtcaccgtctcctcagcctccaccaagggccatcggtcttccccctggcaccctcctccaagagcactctggggggcacagcggccctgggctgcctggtcaaggactacttcctatatactgtctgagcgggctggcaaggcgcatag

SEQ ID NO: 792657 - DNA, 689 bp, Homo sapiens
  misc_feature: 56582.44.36.D03.1.pb.heavy.1.raw 56582
cgtatcgcctccctcgcgccatcagacagtatatacacgaccggtgctcgatttagctgcgtcacgatctctcttgggggagagcggagccccagcccagaattcccaggtgttttcatttggtgatcagcactgaacacagaggactcaccatggagttcgggctgagctgggtttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccaggaaccctggtcaccgtctcctcagcctccaccaagggcccatcggtcttcccctggcgccctgctccaggagcacctccgagagcacagcggcctgggctgcctggtcaagactacttcctatatactgtctgagcggctgcaaggcgcatag

SEQ ID NO: 792658 - DNA, 662 bp, Homo sapiens
  misc_feature: 56598.44.12.B01.1.pb.heavy.1.raw 56598
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgggctccatcagcagtagtagttactactggggctggatccgccagccccagggaaggggctggagtggattgggagtatctattatagtggagcacctactacaaccgtccctcaagagtcgagtcaccatatcagtagacacgtccaagaaccagttctccctgaagctgagctctgtggaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggcctgggctgcctggtcaaggactacttcctatatactgtctgagcgggctggcaaggcgcatag

SEQ ID NO: 792659 - DNA, 567 bp, Homo sapiens
  misc_feature: 56601.44.78.H01.1.pb.heavy.1.raw 56601
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactggtgcgacaggccgctggacaagggctggagtggatgggatggatgaagccctatagtggcaacacggctttgccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgca

SEQ ID NO: 792660 - DNA, 676 bp, Homo sapiens
  misc_feature: 56639.44.27.C05.1.pb.heavy.1.raw 56639
cgtatcgccctccccgcgccatcagacgatcgtaatacacgaccggtgctcgattagacgcgatcgaagggtttggcctggagacgagccagcactgaagtcgccgggtttccactcgcggtgatcatcactgaacacagaggactcaccatgcgagtttgggctgagctgggttttctcgttgccctccttaagaggtgtcatgtgtcaggtgcaattctggagtctggggaggcgtgccccagtagggggtccctgagactctgctgtgcgcctctgattcaccttcgataattgaatatgcagtggcgtccgccaggctccaggcgagggggcgagtggtgcaggtgtgtcatttcatggagaaatcaagtctacggtgattcgttgacgccgattcaccatctccagagaccattccgagaacacagtgtctcttcaaatgaacagcctgagactcaggacacgcgttatttttgtgcgagactatctgttcaaatcggtcattcgacgcctgggcagggaacctggtcagccgtctcctcgcctcaccaaggcccatcggtctcccctggcgccctgctccaggagacctcgaggagcaccagcggccctgctgccgtgtcaaggactacttcctatatactggtctgagcggggctggcaaggcgcatag

SEQ ID NO: 792661 - DNA, 555 bp, Homo sapiens
  misc_feature: 56643.44.27.C05.1.pb.heavy.1.raw 56643
cgtatcgcctccctcgcgccatcagacagtatatacacgaccggtgctcgatttagacgcgatcgaagggtttgggggaggcgtggccccagtaggggggtccctgagactctcctgtgcagcctctggattcaccttccgataatggaatatgcagtggggtccgccaggctcccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacaccgccgtgtatttttgtgcgagactatctgtttccaaaatcgggttcattcgaaacgccttgggccagggaaccctggtcaccgtctcctcggcctccacccaagggccatcggtccttccccctggcgccctgctccaggaagcacctccgagagcacagtgggccctgggctgcctggtcaaggactacttcctatatactgtctgagcgggctggcaaggcgcatag

SEQ ID NO: 792662 - DNA, 669 bp, Homo sapiens
  misc_feature: 56644.44.86.H09.1.pb.heavy.1.raw 56644
ctatgcgccttgccaggcccgctcagaccagttatataggaagtagtccttgaccaggcagccaggggccgctgtgccccagagggtgctcctggagcagggcgccaggggaagaccgatgggcccttgggtggatagctgaggagacagtgaccaggggccacgccccatagattgaaagaccaagtctcgcctccgcacagaaataaaacggccctgtccgcggcgtcacggaggtcagtttcagggagaagcgcttcatggaccgtgtccctcgaaatggtgagacgactcttgagggacggagagtagtacgtccgccccagtataatggatgtccaccaatccactccattcccctccctgggggctgccggatccagccccaagaatgatcagaactgatggaaactccagaggacagtgcagatgagaagacagggttcccgaaggcctcaccagtcctgggcccgactcctgcagctgcaccctggggacaggacccatctgggagctgccaccagccaggaggaaaaaaccacaggtgcttcatgttcttgcacaggaggtccttgactctcagaaagcatccccaaacccaagtctatagcactaaatcgagcaccggtcgtgtatatactgtctgatggcggcgagggaggcgatacg

SEQ ID NO: 792663 - DNA, 699 bp, Homo sapiens
  misc_feature: 56656.44.21.B10.1.pb.heavy.1.raw 56656
ctatgcgccttgccagcccgctcagacagtatataggaagtagtccttgaccaggcagcccagggccgctgtgcccccgaggtgctctggagcagggcgccaggggaagaccgatgggccccttggtggaagcgaagaagaacggtgaccattgtcccctggcccaaatatcaaatgcatcgagcgtcccaggatcgcctgccgcagtaatagacgcctgtgtcgtcgggtctcaggttggcctcatttgtaaatggccaacactgttgggagtcatccttgagaccggtgaatcttcccttcacagacgcgccgtactctttacttccaccataacgtttcattctgacgaaagtgatccactcaagccccttccctggagcctgacggacccaggccaagtgataatcactaagactgaatcctgagactacaccgaggagagtctcagagaccgccctggctgtgccaagcccccccgactccgccagtcgcccctcgcactggacaccttctaaaaaactacaaggaaaatcaagattagcccaaactccatggttggtggtctgtgctcagtggctgatcaccagtggaaactcctgggaatctcacggcctgggggctcctctctctgcgacgacactaaatcgagcaccggtcgtgatagtatagactgatggcggcgagggaggcgatacg

SEQ ID NO: 792664 - DNA, 712 bp, Homo sapiens
  misc_feature: 56690.UNK.UNK.UNK.pb.heavy.1.raw 56690
cgtatcgcctccctcgcgcatcagacagtatatacacgacggtgctcgatttagtagtcgcataagggaaaggggaggctctgagagaggagccccagccccctggattttcaggtgtctcatttggtgaccaggaccgaacagagagaagtctccatggagttttggctgagctgccctttttctgtgctttttaaagggtgtcgtgtgtgaagtgcagttgttggagtctggggggggggggcctgattcgccctggggaggcccctgaccctctcctgtgcggcctctgggatcttcacttagtgcctatggcgatgacctgggtccgccgggctccagggagggactggagtgggggctcaagtatccggagctggtgtgtcactttctacgcgagactccgtgaagggcccgcttcaccatttccagggacaattcgcaggacaaattgtttctccaatgaaaaacctgagacccgaggacacaggcgtctattactgtttgaaagccaggaccacggtgaccccatgacacctttagtacttggggccgggggacagtggtgacgcgtctctcaggcctccaccaaggggcccatcggtcttccctggcgcctgctcaggagcacctcgagagcacagcggccctgggctgcctggtcaaggactacttcctatatactgtctgagcgggctggcaaggcgcatag

SEQ ID NO: 792665 - DNA, 703 bp, Homo sapiens
  misc_feature: 56709.UNK.UNK.UNK.pb.heavy.1.raw 56709
cgtatcgcctccctcgcgccatcagacagtatatacacgacggtgctcgatttagcagacgtctgaacacacaaaggggagctctgggagagagccccagccgtgagatcaggagtttccacttggtgatcagcactgagcacagaccaccaaccatggagtttgggctatcttgattttccttgttagtttttttagaaggtgtccagtgcgaggggcgactggcggagtcggggggggggctggcacagccagggcggtctctgagactctcctgtgtagtctcaggattcagtcttagtgattatcacttggcctgggtccgtcaggctccaggaaggggcttgagtggatcactttcgtcagaatgaaacgtatggtggagtaaagagtacgccgcgtctgtgaagggaagattcaccgtctcaaggatgactccaacagtgttggcatttacaatgagcaacctgagacccgacgacacaggcgtgctattactgcgccaggcgatcctgggacgtcgatgcatttgatatttggggccaggggacaatggtcacgtctcttcagctccaccaggggcccatcggtcttccccctggcgccctgctccaggagcacctctgggggcacagcggccctgggctgcctggtcaaggactacttcctatatactgtctgagcgggctggcaaggcgcatag

SEQ ID NO: 792666 - DNA, 701 bp, Homo sapiens
  misc_feature: 56717.44.36.D03.1.pb.heavy.1.raw 56717
ctatgcgccttgccagcccgctcagacagtatataggaagtagtccttgaccaggcagccagggccgctgtgctctcggaggtgctcctggagcagggcgccaggggaagacgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccaggccccttccctggagcctggcggacccagtccatatagtggtcactgatggtgaatccagaggcgacacaggagagtctcagggaccctccaggctggaccaagtctcccccggactccaccaactgcacttcactctggacacctgtaaaataacaacaaggaaaacccagctcagcccgaactccatggtgagtcctctgtgtcagtgctgatcaccaaatgaaaacacctgggaattctgggctggggctccgctctcagagctccccaagagagatcgtgacgcagctaaatcgagcaccggtcgtgtatatactgtctgatggcgcgcgagggaggcgatacg

SEQ ID NO: 792667 - DNA, 666 bp, Homo sapiens
  misc_feature: 56752.UNK.UNK.UNK.pb.heavy.1.raw 56752
ctatgcgcctgccagccgctcagacagtatatataggaagtagtccttgaccaggcagccagggcgctgtgccccagaggtgctcttggaggagggtgccaggggaagaccgatggcccttgtggaggcggaggcgacggtgaccagggttcctgcccgaagtcaaacgaataataaccactccgacgccgacttgtctccacagtaatagacggccgtgtcgtcgctctcaggttgttcatttgaagataaacgtggttcctggaattgtcctggagatggtgaatcggcccttcacggagtctgcgtagtatgtgaaatcacagtataaatgactgagaccatccagccccttcctgagcctggcggaccaactcattagttgctgctgacggtgagcccagagctgcacaggaagtctctggacccccaggctggactaagcctcctcagactccatcagccgacctcacactggacacctttaaaagtccaacaagagaacccagctcagccaaaactccatggtgagtctctgtgtcagtgctgatcaccgatggaaacacctcgaatccagtgctgggctcctctccccccaaacccaacgtgcgagtgctaatcgagcacgtcgtgtatatactgtctgatgcgcgaggaggcgatacg

SEQ ID NO: 792668 - DNA, 576 bp, Homo sapiens
  misc_feature: 56764.44.78.H01.1.pb.heavy.1.raw 56764
ctatgcgccttgccagcccgctcagacagtatataggaagtagtccttgaccaggcagcccagggccgctgtggctctcggaggtgctcctggagcagggcgccagggggaagaccgatgggcccttggtggaggctgaggagacggtgaccagggttccctggccccacaagtcaagccaggtgctggtggctctcgcaacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgagggcccccaggcttcttcacctcagcagcgtggtgaccgtgacctccagcaacttcggcacccaaacccaaactactcacactaaatcgagcaccggtcgtgtatatactgtctgatggcgcgaggaggcgatacg

SEQ ID NO: 792669 - DNA, 652 bp, Homo sapiens
  misc_feature: 56781.44.86.H09.1.pb.heavy.1.raw 56781
cgtatcgcctccctcgcgccatcagacagtatatacacgaccggtgctcgatttagtgctatagacttggtttggggatgctttctgagagtcaaggaccctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggagggaatggagtggattggtgacatccattatactggggcgaacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgcttccaggagcacctctggggcacagcggccctgggctgcctggtcaagactacttcctatatactgtctgagcgggctggcaaggcgcatag

SEQ ID NO: 792670 - DNA, 608 bp, Homo sapiens
  misc_feature: 56803.UNK.UNK.UNK.pb.heavy.1.raw 56803
cccgacacgcttgctagggacttggagctaaggacgacatattgcctttagacaggtcgaaggtgacgccttagctaccactgaacgtttaggcgccagatgcgtctgggatgacctaactcgcagcttatcgatgatctactgcacgctcaaccaaccagggtcttgatgcgcgcgataggactgacgggatcgctacagacatttaactcgctagtaacttaattgagatcctaggggatggataggaaatagaatccacccctatcaccccccacatagcctgcttggggtgttgagtttacttttatttcgtgttggaatgagttgaacttccgggaagtggagtaatgggtttgtctacttccctaaccgcaaagtactagttttacgagtggccgttgcagccatagccagtcacaggtaataaacaattcaaccgtgcgtaaagattggccgcttgctgtgggcattgcaagctgggtttggcagcattgtggcatgctaggacgacaatatgaatctgcgggacccctagtggccaagatggccgctagcggttccgcagcttttgacctggaccagggtgcatagcctgcccagccttc

SEQ ID NO: 792671 - DNA, 698 bp, Homo sapiens
  misc_feature: 56813.UNK.UNK.UNK.pb.heavy.1.raw 56813
cgtaatcgcctcctcgcgccatcagacagtatatacacgaccggtgctcgatttagctgcggtcacgatctctcttggggagctctgagagcggagcccagcccagaattcccaggtgttttcatttggtgatcagcactgaacacagaggactcaccatggagttcgggctgagctgggtttccttgttgttattttacaaggtgtccagagtgaagtgcagttggtggagtccggggagacttggtccagcctggagggtccctgagactctcctgtgtcgcctctggattcaccatcagtgaccactatatggactggtccgccaggctccagggaaggggctggagtggcttggccgcagtaaaacaaagttgccagcttatcacagagtacgccgcgtctgtgaaagccagattcaccctctcaagagatgacttcaaagaactcattgattctgcgaatgactaacctgaaaacgaggacacgggcatgtattattgtgttgtgtttatatcaggaactgtccactggggccagggaaccctggtcaccgtctcctcagcctccaccaagggcccatcggtcttccccttggcgccctgctccaggagcacctccgagagcacagcggccctggctgcctggtcaaggactacttcctatatactgtctgagcgggctggcaaggcgcatag

SEQ ID NO: 792672 - DNA, 698 bp, Homo sapiens
  misc_feature: 56827.44.55.E11.1.pb.heavy.1.raw 56827
ctatgcgcctttgccagcccgctcagacagtatataggaagtagtccttgaccaggcagcccagggccgctgtgccccagaggtgctcttggaggagggtgccaggggaagaccgatgggccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcacgaatggaaacacctcggaatcccagtgctgggctcctctccccaaacccaacgtgcgagtgctaaatcgagcaccggtcgtgtatatactgtctgatggcgcgaggaggcgatacg

SEQ ID NO: 792673 - DNA, 694 bp, Homo sapiens
  misc_feature: 56848.44.55.E11.1.pb.heavy.1.raw 56848
cgtatcgcctccctcgcgcatcagacagtatatacacgaccggtgctcgatttagcactcgcacgttggtttgggagaggagcccagcactggattccgaggtgtttccattcggtgatcagcaactgaacacagaggactcaccatggagttttggctgagctgggttctcttgttggacttttaaaaggtgtccagtgtgaggtgcggctgatggagtctggaggaggcttagtccagcctggggggtcccagagactctcctgtgcagcctctgggctcaccgtcagcagcaactacatgagtttggtcggcgccaggctccagggaaggggctggagtgggtctcagtcattttatactggtgatttcacatactacgcagactccgtgaagggccgattcaccatctccagggacaattccagaacacggtttatcttcaaatgaacaacctgagaggcgacgacacggccgtctattactgtgcgagacaagtcggcgctcggagtggttattattcgtttgacttctggggccagggaaccctggtcacgtcgcctcgcctccaccaagggcccatcggtcttcccctggcaccctcctccagagcacctctgggggcacagcggccctggctgcctgtcaaggactacttcctatatactgtctgagcggctggcaaggcgcatag

SEQ ID NO: 792674 - DNA, 639 bp, Homo sapiens
  misc_feature: 56854.44.81.H04.1.pb.heavy.1.raw 56854
cgtatcgcctcctcgcgccatcagacagtatatacacgaccggtgctcgattagtagtgtagattcgcgggctttctgagagtcatggacctcctgtgcaagaacatgaagcacctgtggttcttcctcctgctgtggcgctccagatgggtcctgtcccagctgcagctgcaggggtcgggcccaggactggtgaagccttcgagaccctgtccctcactgcactgtctctggtgctccatcagcagtagtagttactactggctggatccgccagcccccagggaaggggctggagtggattgggagtaatctattatagtgggagcacctactacaaccgtccctcagagtcgagtcacatatcagtagacacgtccaagaaccagttctcctgaagctgagctctgtgacgcgcggacacggccgtgtattactgtgcgagagtagggcagttcgtcaccaactactttgaccactggggccagggaaccctggtcaccgtctcctcagcctccaccaagggccatcggtcttcccctggcaccctcctcaagagcacctctggggcacagcggccctggctgcctggtcaaggactacttcctatatactgtctgagcgggctggcaaggcgca

SEQ ID NO: 792675 - DNA, 693 bp, Homo sapiens
  misc_feature: 56877.44.85.H08.1.pb.heavy.1.raw 56877
cgtatcgcctcctcgcgccatcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctggactactactacggtatggacgtctggggccaagggaccacggtcaccgtctcctcagctccaccaagggccatcggtcttcccctggcaccctcctccaagagcacctctggggcacagcggccctgggctgcctggtcaaggactacttcctatatactgtctgagcgggc

SEQ ID NO: 792676 - DNA, 686 bp, Homo sapiens
  misc_feature: 56883.44.45.E01.1.pb.heavy.1.raw 56883
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttccttcgttgctcttttaagaggtgtcccagtgttcaggttcagctggtggagtctgggggaggcgtggtccagcctggacgctccctgagactctcctgtgttgcgtccggactcagtttcagtgactctgccatgcactgggtccgccaggctccaggcaaggggctggagtgggtggcagtcatctggtctgatggaagtaaagaaatactatggaaactccgtgaagggccgattctccgtctccagagacaattccagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagccggccctgggcgcctggtcaaggactacttcctatatactgtctgagcgggctggcaaggcgcatag

SEQ ID NO: 792677 - DNA, 712 bp, Homo sapiens
  misc_feature: 56907.UNK.UNK.UNK.pb.heavy.1.raw 56907
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgacccattgtcccctggccccaaatatcaaatgcatcgacgtcccaggatcgcctgcgcagtaatagacgcctgtgtcgtcaggtctcaggttgctcatttgtaaatggccaacactgtttggagtcatcccttgagacggtgaatcttcccttcacagacgcggcgtactctttacttccaccataacgtttcatttctgacgaaagtgatccactcaagccccttccctggagcctggacggacccaggccaagtgataatcactaagactgaatcctgagactacacaggagagtctcagagaccgccctggctgtggccaaggccccccccgcgacccgccagtcgccgcctcgcactgggacaccttctaaaaaactacaaggaaaatcaagattagcccaaactcccatgggttggtggtctgtgctcagtgctgatcacaagtggaaaacgtccttgggaatcctcacggctgggcctcctctctctttggcgacgaacactaaatcgagcaccggtccgtgtatatactgtctgatggcggcgagggaggcgatacg

SEQ ID NO: 792678 - DNA, 529 bp, Homo sapiens
  misc_feature: 56932.44.43.D10.1.pb.heavy.1.raw 56932
gtatataggaagtagtccttgaccaggcagcccagggccgctgtgcccccagaggtgctcctgggcagggcgccagggggaaagaccgatgggcccctggtggaagctgaggagacggtgaccaggggttccctggccccaggggtcgaacccacctccccgacgagctgcctatactttcgggatcctcgcacagtaatacacggccgtgtcctcagatctcaggctgctcagctccatgttaggctgtgttatggaggtgttcctggtcatggtgactctgccctggaacttctgtgcatagcctgtgttaccactgttaggggttcatccatcccatccactcaagcccttgtccagtggcctgtcgcacccagttgatatcaaattggtgaagggtgtatccagaagccttgcaggagccttcactgaggcccccaggcttctcacctcaggccccttactgctagtctaaatcgagcaccggtcgtgtatattactgtctgatggcgcggagggaggcgatacg

SEQ ID NO: 792679 - DNA, 692 bp, Homo sapiens
  misc_feature: 56941.44.73.G07.1.pb.heavy.1.raw 56941
ctatgcgccttgccagccccgctcagacagtatatagggaagtagtccttgaccaggcagcccagggccgctgtgctctcggaggtgctcctggagcagggcgccagggggaagaccgatgggcccttggtggaggctgaggagacggtgaccagggttccctggccccagtagtcaagcgggaccgtctcgaggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagcccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatacg

SEQ ID NO: 792680 - DNA, 607 bp, Homo sapiens
  misc_feature: 56954.UNK.UNK.UNK.pb.heavy.1.raw 56954
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctagggatggataggaaatagaatccacccctatcacccccccacatagcctgctggggtgttgagtttacttttatttcgtgttggaatgagttgaacttcgggaagtggagtaatgggtttgtctacttcccctaaccgcaaagtactagttttacgagtggcgttgcaagccatagccagtcacaggtaataaacaattcaacgtggcgtaaagattggcccgctgctgtgggcattgcaaagctgggttttgccagcattgtgcatgctagacgacaatatgaatctgcgggacccctagtggccaagatggccgctagcgggttccgcagcttttgacctggaccaggggtgcatagcctgcccagccttc

SEQ ID NO: 792681 - DNA, 672 bp, Homo sapiens
  misc_feature: 56958.44.72.G06.1.pb.heavy.1.raw 56958
cgtatcgcctccctcgcgccatcagacagtatatacacgaccggtgctcgatttagctacgactgcaaggaaaggggagagaggagccttagccctggactccaaggcctttccacttgtgatcagcactgagcacagaggactcaccatggaattgggactgagctgggttttccttgttgctattttagaaggtgtccagtgtgaggtgcaactggtggagtctgggggaggcttggtccagcctggggggtccctgagactctcctgtgcagcctctggattcacctttagtagttattggatgaactgggtccgccaggctccagggaagggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttcccctggcgccctgctccaggagcacctccgagagcacagcggccctgggctgcctggtcaaggactacttcctatatactgtctgagcgg

SEQ ID NO: 792682 - DNA, 692 bp, Homo sapiens
  misc_feature: 56963.44.71.G05.1.pb.heavy.1.raw 56963
cgtatcgcctcctcgcgccatcagacagtatatacacgaccggtgctcgatttagtgtcgtcgcaagagagaggagcccccgagccgtgagattcccaggagtttccaacttggtggatcagccactgagcacgaaccaccaaccatggaggtttgggctaatcttgattttccttgtagttttttagaagggtgtcccagtgcgaggggcgactggcggagtcggggggggcttctggcacagccagggcgggtctctgagactctcctgtgtagtctcaggatcagtcttagtgattatcacttggcctgggtccgtcaggctccagggaaggcttgagtggatcactttcgtcagaatgaaacgttatgggtggaagtaaagagtacggccgcgtctgtgaaggggaagattcaccgtctcaagggatgactccaacagtgttggccatttacaaatgagcaacctgagacccgacgaccacaggcgtctttattactgcgccaggcgatcctgggacggtccgatgcatttgatatttggggccaggtgacaatggtcaccgtctcttcagcttcccaccaaggggcccatcggtcttccccctggccgccctgctccaggagcacctctgcggggcacagcggcccctggctgcctggtcaaggactacttcctatatactgtctga

SEQ ID NO: 792683 - DNA, 715 bp, Homo sapiens
  misc_feature: 56988.44.85.H08.1.pb.heavy.1.raw 56988
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttctggattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcaggacctcccaggctggaccacgcctccccagactcaccagctgcactgacactgacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 792684 - DNA, 719 bp, Homo sapiens
  misc_feature: 56996.44.85.H08.1.pb.heavy.1.raw 56996
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggtttttctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcaggcctccacaagggccatcgtcttcccctggcaccctcctccaagagcacctctgggggcacagcggcctgggctgcctggtcaaggactacttcctatatacttgtctgagcgggctggcaaggcgcatag

SEQ ID NO: 792685 - DNA, 681 bp, Homo sapiens
  misc_feature: 56999.UNK.UNK.UNK.pb.heavy.1.raw 56999
gcgccttgccagccgctcagacagtatataggaagtagtccttgaccaggcagccagggccgctgtgctctcggaggtgctcctggagcagggcgccaggggaagaccgatgggcccttggtggaggccgaggagacggtgaccagggttcctggcccaggcgtcgaatgaaccgattttggaaacagatagtctcgcacaaaatacacggcgtgtcctgaggtctcaggctgttcatttgaagagacactgtgttctcggaatgtctctggagatgggaatcgccctcaacggaatcaccgtagacttgatttcctcatgaaatgacacacctgccacccactccagccctcgcctgagcctggcggacccactgcatattccaattatcgaaggtgaatccagaggctgcacagagagtctcagggacccccctactgggccacgcctccccagactccacgaattgcacctgacacatgacacctcttaagagggcaacgaggaaacccagctcagcccaaactcatggtgagtcctctgtgttcagtgatgatcaccgagtggaaacaccggcgacttccagtgctgggctcgtctcccagccccaaacccttcgatcgcgtctaaatcgagcaccgtcgtgtatatactgtctgatggcgcgagggaggcgatacg

SEQ ID NO: 792686 - DNA, 735 bp, Homo sapiens
  misc_feature: 57007.UNK.UNK.UNK.pb.heavy.1.raw 57007
ctatgcgccttgccagcccgcctcagacagtatataggagtagtccttgaccaggcagcccagggccgctgtggcccccagagtgctcttggaggaggggtgccagggggaagaccgatgggcccttggtggaggctgaggagacggcgaccgtggtcccttggcccaggcgtcccataccattggagtagagcatgtcatatctgtatccacgagccccatctctcgcacagtagtagacagccgtgtcctcggctctcaggctattcatttccagatatagtgtgttccttcgaattgtctctggagatggtgaatcggcccttcacggaatctacataatatttattacttccatcataccatataagtgccacccactccagtcccttgcctggagcctggcggacccagtgcattgccatgtctgttgaaaggtgaatccagaccgctacacagggagtctcagggacctccaggctggaccacgcctcccccagacctccaccagcttcacctgacactgggacacctcttaaagagcacgagaaaacccaggtcagccccaactccatggtgagtcctctgtgttcggtgctgatcaccgactggaaaccaccgccgacttctggtgctgggctcctctcccagagctccccaaacccaacgagctcactctaaatcgagcaccgggtcgtgtatatactgtctgatggcgcgagggagggcgatacg

SEQ ID NO: 792687 - DNA, 679 bp, Homo sapiens
  misc_feature: 57015.UNK.UNK.UNK.pb.heavy.1.raw 57015
cgtatcgcctcgcctcgcgccatcagacgtatatacacgacggtgctcgatttagcacacgatagttggcgtttggggatactttctgagactcatgggcctctgcacaagaacatgaaacacctgtggttcttcctccctcctggtggcacctcccagatggtcgtgtccgaggtgcggctgcaggagtcggcgccagacgggtgaagccttcggagaccctgtccgctcacctgcaatgtctctggtggttacatcagtagttattattggagtggctgcggcagtccgcgggaagggactggagtggattgcggcgcatctataacagtgggcagcaccactacaaccccgccctcaagagtcgagttcaccatgtcactagacaggtccaagaaccagttctccctgaattgaactctgtgaccgccgcggacacggccgtatattattcgtgcgaggagatcctatcgatacagtagagacgggggggcgaactggctcgacccctggggggccaggggaaccctggtcacgtctcctcagcctccacaagggcccatcggtcttcccctggcaccctcctccaagagcacctctgggggcacagcgcccctgggctgcctggtcaaggactacttcctatatactgtctgagcggggctggcaaggcgcatag

SEQ ID NO: 792688 - DNA, 706 bp, Homo sapiens
  misc_feature: 57024.44.67.G01.1.pb.heavy.1.raw 57024
cgtatcgcctccctcgcgccatcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792689 - DNA, 655 bp, Homo sapiens
  misc_feature: 57040.44.86.H09.1.pb.heavy.1.raw 57040
cgtatcggcctccctcgcgccatcagacagtatatacccacgaccggtgctcgatttagtgctatagacttgggtttggggaatgctttctgagagtcaaggacctcctgtgcaagaacatgaagcacctgtggtttttcctcctgctggcagctcccagatggtcctgtcccaggtgcagctggcagagtcgggcccaggactggtgaggccttcgggaaccctgtctctcatctgcacgtgtctctggagtttccatcagttctgatcattcttgggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattttctgtgcgaggcgagactgggtctttcaatctatgggccgtggcaccctggtcactgtctcctcagcttccaccaagggcccatcggtcttccccctggcgcctgctccaggagcacctctggggccacaggcggccctgggctgcctggtcaaggactacttcctatatactgtctgagcgggctggcaaggcgcatag

SEQ ID NO: 792690 - DNA, 707 bp, Homo sapiens
  misc_feature: 57126.44.27.C05.1.pb.heavy.1.raw 57126
ctatgcgccttgccagcccgctcagacagtatataggaagtagtccttgaccaggcagcccaggggccgctgtgctctcggaggtgctcctggagcagggcgccagggggaagaccgatgggccttggtgaggccgaggagacggtgaccagggttcccggtggccccaggcgtcgaatgaaccgattttggaaacagatagtctcgcacaaaaatacacggccgtgtcctgaggtcttcaggctgttcatttgaagagacactgtgtttctcggaattgtctctggagatggatcggccctcaacggaatcaccgtagacttgatttcctccatgaatgacacacctggccacccactccagcccctcgcctggagcctggcggacccactgcatattccattatcgaaggtggaatccagaggctgcacagggagagtctcaggaccccctactggggccacgcctccccccagactccacgaattgcacctgacacatgacacctcttaagagggcacgaggaaaaacccagctcagcccaaactccatggtgagtcctctggttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 792691 - DNA, 675 bp, Homo sapiens
  misc_feature: 57131.44.35.D02.1.pb.heavy.1.raw 57131
cgtatcgcctcctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaacccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 792692 - DNA, 724 bp, Homo sapiens
  misc_feature: 57164.44.85.H08.1.pb.heavy.1.raw 57164
ctatgcgccttgccagcccgctcagacagtatataggaagtagtccttgaccaggccagccccagggccgctgtgcccccagaggtgctcttggaggagggtgccagggggaagaccgatgggccttggtggaggctgaggagacggtgaccgtggtccctggcccccagacgtccataccgtagtagtagtcccagcaggtggtaagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 792693 - DNA, 618 bp, Homo sapiens
  misc_feature: 57184.44.23.C01.1.pb.heavy.1.raw 57184
cgtatcgcctccctcgcgccatcagacagtatatacacgaccggtgctcgatttagtacacgtgattagggattggggcagggtgaacacctgtggtttttcctcctgctggtgcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792694 - DNA, 676 bp, Homo sapiens
  misc_feature: 57186.UNK.UNK.UNK.pb.heavy.1.raw 57186
cgtatcgcctcctcgcgccatcagacagtatatacacgacgtgctcgatttagctctcgctcagggccgctgtgctctcggcggtgttttccatcgggatcagcactgaacacagaggactcaccatggagtttgggctgagctgggttttcctcgttacctttaagaggtgtccatgtcaggtgcacctgtgggtctgggaggcgtgtccgccttgggagggtccctgagactctcctgtgaagcctctggattagtttcagtagttctggcatgcaactgggtccgccaggctccaggcaaggggccgggagttggttggcagttatagcataatgatggaacttctagatattatgcagactccgtgaagggccgattcaccatctccaagagacaattcccggaacactctgtacctggaaatgatcagcctgagaggcgaggactcggctctgtattactgtgcgagatcggaagtggcagcagctattatcgggcgtttcactgggggccagggacactggtcaccgtctcctcagcctccaccaagggcccatcggtcttccccctggcgcctgctccagggcaccctcccgagagcacagcggcctgggctgcctggtcaaggactacttccttatatactgtctgagcgggctggcaaggcgcatag

SEQ ID NO: 792695 - DNA, 698 bp, Homo sapiens
  misc_feature: 57187.UNK.UNK.UNK.pb.heavy.1.raw 57187
gatcgaagtcccttgccatgacagccaccgaccaggccgctcgttgcctccaggttggtgcttcctgagaggagcccgcagtgggaaaccgatgggccattcggtgatcagcatgaacacagagactcaccaggagtttggctgggctggggtcgaacatccttgttggacttttaaaaaggggtccagtgatgaggtgcggctgatgagtctggaggaaggcttagtccagcctggggggtccagagactctctggcagccttcttggctcacgcgtccagcagcaactacatggagtttggcgtatccggccaggctccaggaaggggctgagtgggttctcagtcattccatactgatgattccacaaactacgcagactccgtgaaggggccgattccacctctccagggacaattccaggaacacggtttatcttcaaatgaacaacctgagagggcgacgacacggccgtcattactgtgcgagacaagtcggccgctcggagtggttattattcgtttgacttctggggccagggaaccctggtcaccgtcgctccgcctccaccaagggcccatcggtcttcccctggtaccctcctccaaagagcacctctgaggggcacagcggccctgggctgcctggtcaaggactacttctataaatagtctgagcgggctggcaaggcgcatag

SEQ ID NO: 792696 - DNA, 729 bp, Homo sapiens
  misc_feature: 57203.44.73.G07.1.pb.heavy.1.raw 57203
cgtatcgcctccctctgcgccatcaagacagtatatttaccacgaccggtgctcgatttagctctacgctcagggggggagacgaggcccagcactggaagtcggccggtgttccatcggtattcatcatgaacggtcatttggattcattgcactggaacacaggaggactcccatggactctggctgagatgggttttcctcgttgctcttttaaagaggtggccagtgcaggtgcagctagtggagtctgggggaggagcggcccagcctgggaactcctggagactctcctgtgcagcctctggattcatcttcaggaacctatggccatgcactggtcgccaggctccaggcaaggggctggagtggggtggcaattatatcagaagatggaattgaagaacactacggagactccgagaagggcccgattcaccgtctccagagaccaattccagggaacacactgcatctgcaaatgtacaacctcacaagtgaggacacggctgtctattattgtgcgagagccccctcgagaccggtccccgcttgacctactgggccagggaaccctggtcaccgtctcctcagcctccaccagggcccatcggtcttccccctgggcgccctgctcccaggagcacctccgagagcacagcggcctggctgcctggtcaaggactacacgttcctatatactgtctgagcggctggcaaggcgcatag

SEQ ID NO: 792697 - DNA, 708 bp, Homo sapiens
  misc_feature: 57215.44.36.D03.1.pb.heavy.1.raw 57215
ctatgcgccttgccagccgctcagacagtatataggaagtagtccttgaccaggcagcccagggccgctgtgctctcggaggtgctcctggagcagggcgccagggggaagaccgatgggcccttggtggaggctgaggagacggtgaccagggttccccggccccagtagtcaaaaccagcactgaccaagtggcccgatctctcgaacagaagtagacagccgtgtctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggaccccccccgctgtaccaagcctcccccagactccaccagccgcacctcacagtggacaccttctaaaatagcaacaaggaaaacccagcgcagcccaactccatggtgagtcctctgtgttcagtgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 792698 - DNA, 713 bp, Homo sapiens
  misc_feature: 57216.UNK.UNK.UNK.pb.heavy.1.raw 57216
ctatgcgccttgcagcccgctcagacagtatatacggaagtagtccttgaccaggcagcccaggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaaatacacgccgtgtcctgaggtctcaggctgttcatttgaagagacactgtgttctcggaattgtctctggacgatggtgaatcggcctcaacggaatcaccgtagacttgatttcctccatgaaatgacacacctgccagcccactccagcccctcgcctggagcctggcggacccactgcatattccaattatcgaaggtgaatccagaggctgcacaggagagtctcagggaccccccctactggggccacgcctccccagactcccacgaattgcacctgacacatgacacctcttaagagggcaacgaggaaaaccccagctcagcccaaactccatggtgagtcctctgtgttcagtgatgatcaccggagtggaaacaccggcgacttcagtgctgggctcggtctccagggctccccaaacccttcgatcgcgtctaaatcgagagcaccgggtccgtgatagtatagactgatggcgcggagggaggcgatacg

SEQ ID NO: 792699 - DNA, 721 bp, Homo sapiens
  misc_feature: 57217.44.85.H08.1.pb.heavy.1.raw 57217
ctatgcgcctgccagcccgctcagacagtatataggaagtagtccttgaccaggcagcccagggccgctgtgcccccagaggtgctcttggaggagggtgccagggggaagacgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 792700 - DNA, 685 bp, Homo sapiens
  misc_feature: 57233.UNK.UNK.UNK.pb.heavy.1.raw 57233
tcatgcgccttgccagcccgctcagacagtaataaggaagtgtccttgaccaggggcccaggccgcctggctctcggagggctcctggagcaggcgccaggggggaagaccgatggcccttcggtggaggctgaggagacggtgaccagggtcccctggccccagtcatgccccggtaaacactccacccccgatctcgcacagtaatacagagccgagtcctcgactctcaggctgaccatttccaagtacacaatgttccgggaattgtctctggagatggtgatcggccttcacggagtctgcattaatattcagaacttccatcatgtgctataactgccaaccactccggccccttgcctggcctggcggacccagtgcatgccagaaccactgaactaaatccgaggcttcacaggagagtctcagggactccaggcctggaccacgccccccagactccacaggtgcaccctgacagtggacactcttaaaaagcgaggaaaaccagctcgcccaaatccatggtgagtcctctgtgtcagttgctgacaccgaatggaaacaccgccgactctagtgctgggctcctcctcccagaccctttcccttcacactacactaaatcgagccaccggtcgtcgttatacctcagttctgatggcgcgagggaggcgatacg

SEQ ID NO: 792701 - DNA, 617 bp, Homo sapiens
  misc_feature: 57266.44.38.D05.1.pb.heavy.1.raw 57266
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaaactaagcctcccccggactccaccagctgcacctcacactggacaccttttaaaatagcaacaaggaaaacccagctatcagatactaatcgagcaccggtcgtgtatatactgtctgatggcgcgagggaggcgatacg

SEQ ID NO: 792702 - DNA, 606 bp, Homo sapiens
  misc_feature: 57286.44.36.D03.1.pb.heavy.1.raw 57286
ctatgcgccttgccagcccgctcagacagtatataggaagtagtccttgaccaggcagccaggccgctgtgccccagaggtgctcctggagcagggcgccagggggaagaccgatggcccttggtggagctgaggagacggtgaccgtggtccctttgccccagacgtccagatggtaagacttataatacagaaaccagctgtttctttccccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcggttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtggtatatactgtctgatggcgcgagggaggcgatacg

SEQ ID NO: 792703 - DNA, 697 bp, Homo sapiens
  misc_feature: 57294.44.55.E11.1.pb.heavy.1.raw 57294
cgtatcgcctccctcgcgccatcagacagtatatacacgaccggtgctcgatttagcactcgcacgttgggttggggagaggagcccagcactgggattccgaggttttccattcggttaccactgaaacacagaggactcaccatggagttttggctgagctgggttctcttgtggacttttaaaaggtgtccagtgtggaggtgcggctgatggagtctggaggaggcttagtccagcctggggggtccagagactctcctgtgcaggcctctgggctcaccgtcagcagcaactacatgagtgggtccgccagggctccagggaaggggctggagtgggtctcagtcatttatactggtgatttcacatactacgcagactccgtgaagggccgattcaacatctccagggacaattccaggaacacggtttatcttcaaatgaacaacctgagagggcgacgacacggccgtctattactgtgcgagacaagtcggcgctcggagtggttattattcgtttgacttctgggccagggaacccctggtcaccgtcgcctccgcctccaccaaggcccatcggtcttccccctggcaccctcctccaagagcacctctgggggcacgcgggcctgggctgcctggtcaaggactacttcctatatactgtctgagcgggctggcaaggcgcatag

SEQ ID NO: 792704 - DNA, 672 bp, Homo sapiens
  misc_feature: 57302.UNK.UNK.UNK.pb.heavy.1.raw 57302
ctatgcgccttgcagcccgctcagacagtatataggaagtagtccttgaccaggcagcccagggccgctgtgctctcggaggtgccctggagcagggcgccagggggaagaccgatgggcccttggtggaggctgaggagacggtgaccagggttccctggcccgaatgaaaccatccagacagtaatagacggctgtgtcctcggtgttcaggctgttcatctgcagagacaccgtatcttttgaatcatctcttgagatggtgaatctgcctttcacgggtgcagcgtagtctgttgtcccaccgtcagcttggttctaatacggccaacccactcagccccttccctggagcctggcggacccaggtcatccaggcgttactgaaagtgaatccagaggctgcacaggagagtctaaggactccccaggctttaccaaacctccccagactccaccactgcacctcacactggacaccttttaaaatagcagcaggaaaatccagctcagccaaaactccatggtgagtcctctgtgttcagtcctgatcactgaatgaaaacacctgggaatcccaaggctggggctctctcccagagctcaacacactctctctaaatcgagcaccgtcgtgtatatactgtctgatggcgcgagggaggcgatacg

SEQ ID NO: 792705 - DNA, 706 bp, Homo sapiens
  misc_feature: 57322.UNK.UNK.UNK.pb.heavy.1.raw 57322
cgtatcgccctccctcgcgccatcagacagtatatacacgaccgtgctcgatttagtagttcgcataagggaaagggagctctgagagaggagcccagccctgggattttcaggtgtcttcatttggtgaccaggaccgaacagagagaagtctccatggagtttggggctgagctgccttttcttgtggcttttttaaagggtgtcgtgtgtgaagtgcagttgttggagtctgggggggcctgattcggcctgggaggtccctgaccctctcctgtgcggcctctggattcacctttagtgcctatggcatgacctgggtccgccgggctccaggaggggactggagtgggtctcaagtatcggagctggtggtgtcactttctacggagactcccgtgaagggccgcttcaccatttccagggacaattcgcaggacaaattgtttctccaaatgaaaaacctgagacccgaggacacaggcgtctatactgtttgaaagccaggaccacggtgacccccccatgacacctttagtacttggggccggggacagtggtgaccgtctcttcagcctccaccaagggcccatcggtcttccccctggcgccctgctccaggagcacctccgagagcacagcggccctgggctgcctggtcaaggactattcctatatactgtctaagcggctggcaggcgcatag

SEQ ID NO: 792706 - DNA, 637 bp, Homo sapiens
  misc_feature: 57329.UNK.UNK.UNK.pb.heavy.1.raw 57329
cgtatcgcctccctcgcgccatcagacagtatatacacggaccggtgctcgatttagtgctatagacttggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgtggaaccctgtctctcatctgcactgtctctggagtttcatcagtttctgatcattcttgggctggatccggcagccccagggaggggaatggagtggattggtgacatccattatactggggcgacgtactactctccgtccctcaaggtcgtctcaccatttcgaggggacacgtccatgaaccgcttctccctgaaactgacctccgtgaccgccgcggacacggccgtttattctgtgcgaggcgagactggttttcaatctatgggccgtgcaccctgtcacgtctcctcagcttccaccaaggcccatcgtcctcccctggccctgctccaggagcacctctggggcacagcggccctgggctgctggtcaaggactcttctatatacgtctgagcgggctggcaaggcgcatag

SEQ ID NO: 792707 - DNA, 704 bp, Homo sapiens
  misc_feature: 57393.44.27.C05.1.pb.heavy.1.raw 57393
cgtatcgcctccctcgcgccatcagacagtatatacacgaccggtgctcgatttagacgcgatcgaaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgacagcctgagacctcaggacacggccgtgtatttttgtgcgagactatctgtttccaaaatcggttcattcgacgcctggggccagggaaccctggtcaccgtctcctcggcctccacaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792708 - DNA, 664 bp, Homo sapiens
  misc_feature: 57394.44.35.D02.1.pb.heavy.1.raw 57394
cgtatcgcctccctcgcgccatcagacagtatatacacgaccggtgctcgatttagcacacgatagttgggtttgggatacttttgagactcatgcctcctgcacaagaaccatgaaacacctgtgttcttcctcctcctggtggcacctcccagatgggtcgtgtccgaggtgcagctgcaggagtcgggcccaggacgggtgagccttcgagaccctgtccctcacctgaatgtctctggtggttacatcagtagttattattggagttggctgcggcagtccgccgggaaggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcgaactgctcgaccctggggccaggaaccctggtcaccgtctcctcagcctccaccaagggcccatcggtcttcccctggcacctcctccaagagcactctgggggcacagcggccctgggctgcctggtcaaggactacttcctatatactgtctgagcgggctggcaaggcgcatag

SEQ ID NO: 792709 - DNA, 681 bp, Homo sapiens
  misc_feature: 57399.44.72.G06.1.pb.heavy.1.raw 57399
cgtatcgcctccctcgcgccatcagacagtatatacacgaccggtgctcgatttagctacgactgcaaggaaaggggagagaggagccttagcctggactccaaggcctttccacttggtgatcagcactgagcacagaggaactcaccatggattgggactgagctgggttttccttgttgctatttagaaggtgtccagttgtgagggtgcaactggtgagtctgggggaggcttggtccagcctgggggtcctgagactctctgtgcagcctctggattcacctttagtagttattggatgaactgggtccgccaggctccagggaggggctgggtgggtggccatcatgaagaaagatggaactgagacacactatgtggactctgtgaagggccgatcaccatctccagagacaacgccaagaactcactgtatctgcaaatgaacagtctgagagtcgaggacacggctgtgtattatgtgcgggaggcgcgggtggctcattgactactggggtcaggaaccctggtcaccgtctcctcagcctccaccaagggcccatcggtcttccccctggcgccctgctccaggagcacctccgagagcacagcggccctgggctgcctggtcaaggactacttcctataactgtctgagcgggctggcaaggcgcatag

SEQ ID NO: 792710 - DNA, 728 bp, Homo sapiens
  misc_feature: 57431.UNK.UNK.UNK.pb.heavy.1.raw 57431
cgtatcgcctccctcgcgccatcagaacagtatatacacgaccggtgctcgatttagagtggctcgttggtttggggagctctgggagagagcccagcaccagaaagtcggcgtgtttccagtcggtgatcagcaccgaacacagaggactcaccatggagtttgggctgacctgggttttcctcgttgctcttttaagaggtgtccagtgtcaggtgaagctggtggagttcctggggaggcgtggtccagcctggaggtccctgagactctcctgtgtagcggtctggattcaccttcaacagacatggcatgcactggtccgcccaggctccaggcaagggactggagtggtggcacttatatggtatgatggaagtaataaatattatgtagattccgtgaagggccgattcaccatctccgagacaattcgaagaacacactatatctggaaatgaatagcctgagagccgaggacaggcctgtctactactgtgcgagagatggggctcgtggatacagatatgacatgctctactcccaatgtatggacgcctggggccaagggaccgacggtcgccgttctccttcagcctccacaagggcccatcggtctccccctgggccacctcctccaagagcacctctgggggcacagcggccctgggctgcctggtcaaggactacttcctatatactgtctgagcgggctggcaaggcgcata

SEQ ID NO: 792711 - DNA, 722 bp, Homo sapiens
  misc_feature: 57439.44.85.H08.1.pb.heavy.1.raw 57439
ctatgcgccttgccagcccgctcagacagtatataggaagtagtccttgaccaggcagcccagggccgctgtgcccccagaggtgctcttggaggagggtgccagggggaagacccgatgggcccttggtggaggctgaggagacggtgaccgtggtcccttggccccagacgtcccataccgtagtagtagtcccagcaggtgggtagtactacatatgtcctcgcacagtaatacacagccgtgtctcggctctcaggctgttcatattgcagatacagcgtgttcttggaattgtctctggagatggtgaatcggcccttcacggagtctgcatagtatttattacttccatcataccatataagtgccacccactccagcccttgcctggagcctggcggaccagtgcatgccataggtactgaaggtgaatccagacggctgcacaggagagtctcagggacctcccaggctggacacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctccagagctccccgcgactgagtgatactaaatcgagcaccggtcgtgtatatactgtctgatggcgcgagggaggcgatacg

SEQ ID NO: 792712 - DNA, 662 bp, Homo sapiens
  misc_feature: 57455.44.45.E01.1.pb.heavy.1.raw 57455
ctatgcgccttgccagcccgctcagacagtatataggagtagtccttgaccaggcagccaggcgctgtgctctcggaggtgctctggagcagggcgccagggggaagaccgatgggcccttggtggaggctgaggagacggtgaccagggctcctgccccagtagaacgatggctcgtacaataatagagagccgagtcctcggctctcaattgttcatttgtagatcacggtgttcttggaattgtctctgagacggagaatcggcccccttcacggagttccatagtattctttacttccatcagaccagatgactgccacccacccagccccttgcctggagcctggcggaccagtgcatggcagagtcactgaaatgagtccggacgcaacacaggagagtctcaggacgtcccaggctggaccacgcctcccccagactcaccagctgaacctgacactgacacctcttaaaagagcaacgaggaaaaccagctcagcccaactccatggtgagtcctctgtgttcagtgctgatcaccgaatggaaacaccgccgacttctagtgctggctcctctccagccccttcccttactgactcactaaatcgagcaccggtcgtgatagtatagactgatggcgcgagggaggcgatacg

SEQ ID NO: 792713 - DNA, 545 bp, Homo sapiens
  misc_feature: 57458.44.43.D10.1.pb.heavy.1.raw 57458
cgtatcgcctccctcgcgccatcagacagtaatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaaggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgaccctgggccagggaaccctggtcaccgtctcctcagcttccaccagggcccatcggtcttccccctggcgccctgctccaggagcacctctgggggcacagcggccctggctgcctggtaaggactacttcctatatactgtctgagcgggctggcaaggcgcatag

SEQ ID NO: 792714 - DNA, 690 bp, Homo sapiens
  misc_feature: 57464.44.36.D03.1.pb.heavy.1.raw 57464
cgtatcgcctccctcgcgccatcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtcctgagactctctgtgtcgcctctggattcaccatcagtgaccactatatggactgggtccgccaggctccagggaaagggctggagtggcttggcccagtaaaaacaaagttgccagctttatcacagagtacgccgcgtctgtgaaagccagattcaccctctcaagagatgacttcaagaaactcattgattctgcgaatgactaacctgaaaaccgaggacacgggcatgtattattgtgttgtgtttatatcaggaactgtccactgggccagggaaccctggtcaccgtctcctcagccctcacaagggcatcgtcttcccgccggcgccctgctccaggaggcacctcgagagcacagcggccctgggctgcctggtcaaggactacttcctatatactgtctgagcgggctggcaaggcgcatag

SEQ ID NO: 792715 - DNA, 651 bp, Homo sapiens
  misc_feature: 57471.44.86.H09.1.pb.heavy.1.raw 57471
cgtatcgcctccctcgcgccatcagacagtatatacacgaccggtgctcgatttagtgctatagacttgggtttggggatggctttctgagagtcaaggacctcctgtgcaagaacatgaagcacctgtggtttttcctcctgctggtggcagctcccagatgggtcctgtccaggtggcagctgcaggagtcgggcccaggactggtgaggccttcggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcaatctatggggccgtggcaccctggtcactgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 792716 - DNA, 692 bp, Homo sapiens
  misc_feature: 57489.44.74.G08.1.pb.heavy.1.raw 57489
ctatgcgccttgccagcccgctcagacagtatataggaagtagtccttgaccaggcagcccagggccgctgtgccccagaggtgctcctggagcagggcgccagggggaagaccgatgggcccttggtggaagctgaggtgacaatgaccagggttccctgccccagatctcaaaggctccatgcgagctgggtacggacctctcgcacagtagtagacggccgtgtcgtcggatttcaaagaactcattgtcatggagactgtgtctgtggacttgttccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 792717 - DNA, 1395 bp, Homo sapiens
  misc_feature: 57498.44.27.C05.1.pb.heavy.1.raw 57498
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtaggggggtcctgagactctcctgtgcaggcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattcgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccaccaagggcccatcggtcttcccccctggcgccctgctccaggagcacctccgagagcacagcggccctgggcctgcctggtcaaggactacttcctatatactgtctgagcgggctggcaaggcgcatagatcgcctccctcgcgcgccatcagacagtatatacacgaccggtgctcgatttgatcacataacaaccacaactcctcctctaaagaagccccctgggagcacagctcatcaccatggactggacctggcggttcctctttgtggtgcagcagctacaggtgtccagtcccaggtgcagctggtgcagtctggggctgaggtgaagaagcctgggtcctcggtgaaggtctcctgcaaggccttctggaggcaccttcttcagctatgcctttatttggtgcgacaggcccctggacaagggcttgagtgctgggagggatcatccctatctttggtgcatcgaattacgcacagaagtttcaggacagagtcaccattaccgcggacgaatccacgagtacagcctacatggagctgagcaggctgagatctgaagacacggccatctatttctgtgccgagagccctcgtcaactttcatagtccctctcatagtcccacacatggaaattggttcgacccctggggccagggaaccctggtcaccgtctcctcagcttccaccaagggcccatcggtcttcgcctggcgccctgctccaggagcacctctgggggcacagcggccctgggctgcctggtcaaggactacttcctatatactgtctgagcgggctggcaaggcgcatag

SEQ ID NO: 792718 - DNA, 612 bp, Homo sapiens
  misc_feature: 57527.UNK.UNK.UNK.pb.heavy.1.raw 57527
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaactttccgggaagtggagtaatgggtttgtctacttcccctaaccgcaaagtactagttttacgagtggcgttgcaagccatagccagtcacaggtaataaacacattcacgtggcgtaaagattggccgcttgctgtgggcattggcaagctgggtttgcagcattgtgcatgctagacgacaatatgaatctgcgggaccctagtggccaagatggccgctagcgggtttccggccagcttttgacctggaccaggggtgcatagcctgcccagccttc

SEQ ID NO: 792719 - DNA, 699 bp, Homo sapiens
  misc_feature: 57546.44.74.G08.1.pb.heavy.1.raw 57546
ctatgcgccttgccagcccgcctcagacagtatataggaagtagtcccttgaccaggcagcccaggggcccgctgtgcccagaggtgctcctggagcagggcgccaggggggaagaaccgaatgggcccccttggtggaagctgaggtgacaatgaccagggttccctggccccagatctcaaaggctccatgcgagctggggtacggacctctcgcacagtagtagacggccggtgtcgtcgatttcaaagaactcattgccatggagactgtgtctgtggactttgtccgcggtaatcgtaattctgccccggaagtctcgtgcgtaggtgagtgagccaaaaagaggatgattccacccatccactcaagcccttgtccagggcctggcgcacccagttgatggtataagtagttggaactggtagtacttccagagccgtgcaggaaagggtcacgaggaccaaggttgcggcattctagtcccagactgcaccagttgcaccaggactggacacctgttgctgctgccaccacaaagaggaacctccaggtccagtccatggtgatgagctgtgctcccaggggcttctttagaggaggaaatgtggttgttatgtgatgctccccctgatagagctactaaatcgagcaccggtcgtgtatatactgtctgatggcgcgagggaggcgatacg

SEQ ID NO: 792720 - DNA, 714 bp, Homo sapiens
  misc_feature: 57567.44.56.F01.1.pb.heavy.1.raw 57567
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcgggggggggcttggcacagccagggcggtctctgagactctcctgtgtagtctcaggattcagtcttagtgattatcacttggcctggtccgtcaggctccagggaagggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792721 - DNA, 719 bp, Homo sapiens
  misc_feature: 57570.44.56.F01.1.pb.heavy.1.raw 57570
cgtatcgcctccctcgcgccatcagacagtatatacacgaccggtgctcgattttagcagacgtctgaacacacaaagggggagctctggagaggagccccagccgtgagattcccaggagtttcccacttggtgatcagccactgagcacagaccaccaaccatggagtttgggctaatcttgattttccttgtagtttttttagaaaggtgtccagtgcgagggcgactggcggagtcggggggggggcttggcacagccagggcggtctctgagactctcctgtgtagtctcaggattcagtcttagtgattatcacttggcctgggtccgtcaggctccagggaagggcttgagtggatcactttcgtcagaatgaaacgtttatggtggaagtaaagagtacgccgcgtctgtgaagggaaagattcaccgtctcaagggatgactccaaacagtgttggccatttacaaatgagcaacctgagacccgacgacacaggcgtctattactgcgccaggcgatcctgggacgtcgatgcatttgatatttgggccaggggacatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792722 - DNA, 662 bp, Homo sapiens
  misc_feature: 57574.44.12.B01.1.pb.heavy.1.raw 57574
cgtatcgcctccctcgcgccatcagacagtatatacacgaccggtgctcgatttagtagtgtagattccgcggggctttctgagagtcatggacctcctgtgcaagaacataagcacctgtgtttcttcctcctgctggtggcggctcccagatgggtcctgtcccagctgcagctgcaggagtcgggcccaggactggtgaagccttcggagaccctgtccctcactgcactgtctctggtggctccatcgcagtagtagttactactggggctggatccccaagcccccagggaaggggctggagtggattgggagtatcattatagtgggagcacctactacaacccgtccctcaagagtcgagtcaccatatcagtagacacgtccaagaaccagttctccctgaagctgaggcttctgtgaccggccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 792723 - DNA, 729 bp, Homo sapiens
  misc_feature: 57575.44.62.F07.1.pb.heavy.1.raw 57575
cgtatcgcctcccctcgcggccatcagacagtatatagcacgaccggtgctcgatttagtagtcgcataaagggaaaggggagctctgagagaggagcccagcgccctggattttcaggggtccttcatttggtgaccaggaccgaacagagagaagtctccatggagtttgggctgagctgccctttttctgtggcttttttaaagggtgtcgtgtgtgaagtgcagttgttggagtcctgggggggcctgattcggcctgggaggctcgcctgaccctctcctgtgcggcctctggattcacctttagtgccctatggcatgacctgggtccgccgggctccaggaggggactggagtgggtctcaagtatcggagctggtggtgtcactttctaacggagactccgtgaagggccggcttcaccatttccagggacaattcgcaggacaaattgtttctccaaatgaaaaacctgagacccggaggacacaggcgtctattactgtttgaaagccaggaccacggtgaccccccccatgacacctttagtacttggggcccgggggacagtggtggaccgtctcttcagccctccaccaaggggcccatcggtcttcccctggcgccctggctccaggagcacctccgagagcacagcggccctgggctgcctggtcaaggactacttcctatatactgtctgagcggggctggcaaggcgcatag

SEQ ID NO: 792724 - DNA, 703 bp, Homo sapiens
  misc_feature: 57583.44.27.C05.1.pb.heavy.1.raw 57583
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 792725 - DNA, 642 bp, Homo sapiens
  misc_feature: 57585.UNK.UNK.UNK.pb.heavy.1.raw 57585
cgtatcgcctccctcgcgccatcagacagtatatacacgaccggtgctcgatttgtgctatagacttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggaggggaatggagtggattggtgacatccatatactggggcgacgtactactctccgtccctcaagagtcgtctcaccattttcgagggacacgtccatgaaccgcttctcctgaaactgacctcgtggacgcggacacggccgtttatttctgtgcgaggcgagactggtctttcaatctatggggccgtggcaccctggtcactgtctcctcagcttccaccaagggcccatcgtcttccctggcgccctgctccaggagcacctctgggggcacagcggccctgggctgcctggtcaaggactacttcctatatactgtctgagcggctggcaaggcgcatag

SEQ ID NO: 792726 - DNA, 701 bp, Homo sapiens
  misc_feature: 57606.44.55.E11.1.pb.heavy.1.raw 57606
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggcccgattcaccatctccagggacaattccaggacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcggtcttccccctggcaccctcctccaagagcacctctggggcacagcggccctgggctgcctggtcaaggactaacttcctatatactgtctgagcgggctgggcaaggcgcatag

SEQ ID NO: 792727 - DNA, 706 bp, Homo sapiens
  misc_feature: 57628.44.55.E11.1.pb.heavy.1.raw 57628
cgtatcgcctccccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctggctgcctggtcaaggactactttcctatatactgtctgagcgggctggcaggcgcatag

SEQ ID NO: 792728 - DNA, 694 bp, Homo sapiens
  misc_feature: 57629.UNK.UNK.UNK.pb.heavy.1.raw 57629
cgtatcgcctccctccgcgccatcagacagtatatacacgaccggtgctcgatttagtgagtccagtaagggaaaggggggctgggagaggagcccagcactagaagtcggcggtgtttccattcggtgatcagcactgaacacaagaggactcaccatggagttttgggcctgagctgggttttctcgttgctcttttaagaggtgtccagtgtcaggttcagctggtggagtctggggggaggcgtggtccagcctgggacgtccctgagactctcctgtgttgcgtccggactcagtttccagtgactctgccatgcactgggtccgccaggcccaggcaagggctggagtggtggcagtcatctggtctgatggaagtaaagaatactatggaaactccgtgaagggccgattctccgtctccagagaccaattccaagaacaccggtgtatctacaaatgaacaatttgagagccgaggactcggctctctattattgtacgagcccatcgttctactggggccagggagccctggtcaccgtctcctcagcctcccaccaagggcccatcggtcttcccccctggcgccctgctccaggagcaccttccgagaagcacagcggccctgggctgcctggtcaaggactacttcctatatactgtctgagcgggctggcaaggcgcatag

SEQ ID NO: 792729 - DNA, 695 bp, Homo sapiens
  misc_feature: 57655.44.73.G07.1.pb.heavy.1.raw 57655
ctatgcgcttgccagccgccagacagtatatagaagtgtccttgaccaggcagcccagggcccgctgtgctctcggaggtgctcctgggcagggcgccagggggaagacgatgggccccttggtggaggctgaggagacggtgaccagtgtcccctggccccagtgaaacgcccgataatagctgctgccacttcccgatccgcacagtaatacagagccgagtcctcgcctctcaggctgatcatttccaggtacagagtgttccgggaattgtctctggagatggtgaatcggcccttcacggagtctgcataatatctagaagttccatcatatgctataacgccaaaccactccggcccctgcctgagccgggcggacccagtgcatgccagaactactgaaactaaatccagaggcttcacaggagagtctcagggacctcccaggctggacacgcctccccagactccaccaggtgcacctgacactggacacctcttaaaagagtaacgaggaaaacccagctcagcccaaaactcccatggtgagtcctctgtgttcagtgctgatcaccgaatggaaacaccgccgacttctagtgctgggctctctcccagagctcccctgagcgtagagctaatcgagcaccggtcgtgtatatactgtctgatggcgcgagggaggcgatacg

SEQ ID NO: 792730 - DNA, 672 bp, Homo sapiens
  misc_feature: 57673.UNK.UNK.UNK.pb.heavy.1.raw 57673
atcgcctccctcgcgccatcagacagtatatacacgacggtgctcgattttagctctacgctcagggggggagacgagcccagcactggaagtcgccggtgtttccattcggtgatcatcactgaaacagaggactcaccatggactttgggctgagatgggttttcctcgttgctcttttaagagtggccagtgtcaggtgcagctagtggagtctgggggaggagcggcccagcctgggaactcctgagactctcctgtgcagcctctggattcatcttcaggacctatgccatgcactgggtcgccaggctcaggcaagggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagcccctcgagacggtcccgcttgactactggggccagggaaccctggtcaccgtctcctcagcctccaccaagggccatcggtcttcccctggcgccctgctcaggcactccgagagcacagcggcctggctgcctggtcaaggactacttctatatactgtctgagcggctggcaaggcgcatag

SEQ ID NO: 792731 - DNA, 686 bp, Homo sapiens
  misc_feature: 57701.UNK.UNK.UNK.pb.heavy.1.raw 57701
ctatgcgccttgccagccgctcagaagttataggaagtagtccttgaccaggcagcccagggccgctgtgctctcgaggtgccctggagcagggcgccagggggaagaccgatgggcccttggtggaggctgagagacggtgaccagggttccctggcccagtggacagttcctgatataaacacaacacaataatacatgcccgtgtcctcggtttttcaggttagtcattcgcagaatcaatgagttcttgaagtcatctcttgagagggtgaatctggctttcacagacgcggcgtactctgtgataaagctggcaacttgtttttactgcggccaagccactccagccccttcctggaggcctggcggacccagtccatatagtggtcactgatggtgaatccagagcgacacaggagagtctcagggaccctccagctggaccagtctccccggactccaccaactgcacttcactctggacaccttgtaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcacggtcgtgtatatactgtctgatggcgcgagggaggcgatacg

SEQ ID NO: 792732 - DNA, 702 bp, Homo sapiens
  misc_feature: 57704.44.62.F07.1.pb.heavy.1.raw 57704
cgtatcgccttccctcgcgcatcagacagtatatacacgaccggtgctcgattagtagtcgcataaaggaaaggggagctctgagagaggagcccagcctgggattttcaggtgtcttcattggtgaccaggaccgaacagagagaagtctccatgggagtttggctgagctgcctttttcttgtggcttttttaaagggtgtcgggtgtggaagtgcagttgttggagtctgggggggcctgattcggcctgggaggtccctgaccctctcctgtgcgcctctggattcacctttagtgcctatggcatgacctgggtccgccgggctccagggagggactggagtgggtctcaagtatcggagctggtggtgtcactttctacggagactccgtgaaggccgcttcaccatttccagggacaattcgcaggacaaattgtttctccaaatgaaaaacctgagaacccgaggacacaggcgtctattactgttgaaagccaggaccacggtgaccccccatgacaccttttagtacttggggccgggggacagtggtgaccgtctcttcagcctccaccaagggcccatcgtcttcccctggcgccctgctccaggagcacctccggagcacagcggccctggctgcctggtcaaggactacttcctatatactgtctgagcgggctggcaaggcgcatag

SEQ ID NO: 792733 - DNA, 663 bp, Homo sapiens
  misc_feature: 57734.44.86.H09.1.pb.heavy.1.raw 57734
ctatgcgccttgccagcccgctcaagacagtatataggaagtagtccttgaccaggcagcccagggccgctgtgccccagaggtgctcctggagcagggcgccagggggaagacccgatgggcccttggtggaagctgaggagacagtgaccagggtgccaccggcccccatagattgaaagaccagtcctcgcctcgcacagaaataaacggccgtgtccgcggcggtcacggaggtcagtttcagggagaagcgggttcatggacgtgtccctcgaaatggtgagacgactcttgagggacggagagtagtacgtcgccccagtataatggatgtcaccaatccactccatttcccctccctgggggctgccggatccagccccaagaatgatcagaactgatggaaactccagagacagtgcagatgagagacagggttcccgaaggcctcaccagtcctggggcccgactcctgcagctgcacctgggacaggacccatctgggagctgccaccagcaggaggaaaaaccacaggtgctttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 792734 - DNA, 633 bp, Homo sapiens
  misc_feature: 57782.44.86.H09.1.pb.heavy.1.raw 57782
cccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacgccgtgtccgcggcggtcacggaggtcagtttcagggagaagcggttcatggacgtgtccctcgaaatggtgagacgactcttgagggacggagagtagtacgtcgccccagtataatggatgtcacaatccactccattcccctccctgggggctgccggatccagccccaagaatgatcagaactgatggaaactccagagacagtgcagatgagagacagggttcccgaaggcctcaccagtctggcccgactcctgcagctgcacctgggacaggacccatctgggagctgccacagcaggaggaaaaaccacaggtgcttcatgttctgcacaggaggtccttgactctcagaaagcatccccaaacccaagtctatagcactaaatcgagcaccggtcgtgtatatactgtctgatggcgcgagggaggcgatacg

SEQ ID NO: 792735 - DNA, 596 bp, Homo sapiens
  misc_feature: 57786.UNK.UNK.UNK.pb.heavy.1.raw 57786
ccgacacgcttgctaggacttggagctaaggacgacatattgccttagacagtcgaagtgacgccttagctaccactgacgtttaggcgccagatgcgtctggatgacctaactcgcagcttatcgatgatctactgcacgctcaaccaaccaggtcttgatgcgcgcgatagactgacggatcgctacagacatttaactcgctagtaacttaattgagatcctaggggatgggataggaaatagaatccaccccctatcaccccccacatagcccctgcttgggtgttgagtttacttttatttcgtgttgaatgagttgaacttcgggaagtggagtaatggtttgtctacttccccctaaccgcaaagtactagttttacgagtggcgttgcaagccatagccagtcacaggtaataaaacaattcaacgtggcgtaaagattggccgttgctgtggcattgcaagctgggtttggcagcattgtgcatgctagacgacaatatgaatctgcgggacccctagtggccaagatggccgctagcgggttccgcagctttgacctggacagggtgcatagctgccccagccttc

SEQ ID NO: 792736 - DNA, 663 bp, Homo sapiens
  misc_feature: 57790.UNK.UNK.UNK.pb.heavy.1.raw 57790
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagcccccagtagtaactactactgctgatggagccaccagagacagtgcaggtgagggacagggtctccgaaggcttcacagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcacggtcgtgttatactgtctgatggcgcgagggaggcgatacg

SEQ ID NO: 792737 - DNA, 605 bp, Homo sapiens
  misc_feature: 57791.44.36.D03.1.pb.heavy.1.raw 57791
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggcctggctgcctggtcaaggactacttcctatatactgtctgagcgggctggcaaggcgcatag

SEQ ID NO: 792738 - DNA, 692 bp, Homo sapiens
  misc_feature: 57800.44.36.D03.1.pb.heavy.1.raw 57800
cgtatcgcctcccctcgcgccatcagacagtatatacacgaccggtgctcgattagctgcgtcacgatctctcttggggagctctgagagcggagcccagccccagaattcccaggtgtttcatttggtgatcagcactgaacacagaggactcaccatggagttcgggctgagctggttttccttgttgttattttacaaggtgtccagagtgaagtgcagttggtggagtcgggggagacttggtccagctggagggtccctgagactctcctgtgtcgcctctggattcaccatcagtgaccacatatggactgggtccgccaggctccagggaaggggctggagtggcttggccgcagtaaaaacaaagtgccagctttatcacagagtacgccgcgtctgtgaaagcccagattcaccctctcagagatgacttcaagaactcattgattctgcgaatgactaacctgaaaccgaggacacgggcatgtattatgtgttgtgtttatatcaggaactgtccactggggccagggaaccctggtcaccgtctcctcagcctccaccaagggccatcgtcttccccctggcgccctgctccaggagcactccgagagcacagcggccctgggctgcctggtcaaggactacttcctatatactgtctgagcgggctggcaggcgcatag

SEQ ID NO: 792739 - DNA, 665 bp, Homo sapiens
  misc_feature: 57805.44.12.B01.1.pb.heavy.1.raw 57805
ctatgcgccttgccagcccgctcagacagtatataggaagtagtccttgaccaggcagcccagggccgctgtgcccccagaggtgctcttggaggaggggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctcgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggagggcgatacg

SEQ ID NO: 792740 - DNA, 678 bp, Homo sapiens
  misc_feature: 57815.44.19.B08.1.pb.heavy.1.raw 57815
ctatgcgccttgccagcccgctcagacagtatataggaagtagtccttgaccaggcagaccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattcttacttccatcagaccagatgactgccacccactccagccccttcctggagcctggcggacccagtgcatggcagagtcactgaaactgagtcggacgcaacacaggagagtctcagggacgtcccaggctggaccacgcctcccccagactccaccagctgaacctgacactggacacctcttaaagagcaacgaggaaaacccagctcagcccaaactccatggtgatcctctgtgttcagtgctgatcaccgaatggaaacaccgccgacttctagtgctgggctcctctcccagcccctttcctttactgactcactaaatcgagcaccggtcgtgtatatactgtctgatggcgcgagggaggcgatacg

SEQ ID NO: 792741 - DNA, 698 bp, Homo sapiens
  misc_feature: 57816.44.73.G07.1.pb.heavy.1.raw 57816
cgtatcgcctccctcgcgccatcagacagtatatacacgaccggtgctcgatttagctctacgctcagggggggagacgagcccagcactggaaagtcgccggtgtttccattcggtgatcatcactgaacacagaggactcaccatggactttgggctgagaatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaagggctggagtgggtggcaattatatcagaagatggaattgaagaacactacggagactccgagaagggccgattcaccgtctccagagacaattccaggaacacactgcatctgcaaatgtacaaacctcacaagtgaggacacggctgtctattattgtgcgagagccccctcgagacggtccccgcttgactactggggccagggaacccctgggtcaccgtctcctcagcctccaccaagggcccatcggtcttccccctggcgccctgctccaggagcaccttccgagagcacagcggccctgggctgcctggtcaaggactacttcctatatactgtctgagcgggctggcaaggcgcatag

SEQ ID NO: 792742 - DNA, 721 bp, Homo sapiens
  misc_feature: 57841.UNK.UNK.UNK.pb.heavy.1.raw 57841
gcgtaatcgccctccccctcgcgcgccattcagacagtatatacacgaccggtgctcgatttagtggtagtgtgtgaagggaaaggggtctgggagaggaggcccagcactagaagtcgccgcgtgtttccattcggtgatcagccactgaacacagaggactcaccatggagttttgggctgagctgggttttcctcgttgctcttttaagaggtgtccactgtcaggtgccacctggtggagtctggggaggcgtggtccagcctgggaggtccctgagactctcctgtgaagccctctggatttagtttcagtggttctggccatgcactgggtccgccaggctccaggcaaggggcccggagtggttggcagttatagcacatgatggaagttctgaatattatgcagactccgtgaagggccgattcaccatctccagagacaattcccgcggaacattgtgtacttggaaatggtcagcctgagagtcgaggactcggctctgtattactgtgcgagatcgggaggcgtggtagtagttattaccgggcgcgcatgactgggcggcggcagggggaccctggtcaccgtctcctcagcctccaccaagggcccatcggtctttccccctggcgcccctgctccaggagcacctccgagagcacagcggccctgggcctgcctggtcaaggaactacttcctatatactgtctgag

SEQ ID NO: 792743 - DNA, 678 bp, Homo sapiens
  misc_feature: 57862.44.71.G05.1.pb.heavy.1.raw 57862
cgtatcgcctccctcgcgccatcagacagtatatacacgaccggtgctcgatttagtgtcgtcgcaagagagaggggcccagccctggggactgaacagaagagaactcaccatggagtttgggctgagctggctttttcttgtggctgttttaaaaggtgtccagtgtgaagtgcagctgttggagtcgggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctggggcaaaagggaccccggtcaccgtctcctcagcctccaccaagggcccatcggtcttcccccctggcaccctcctccaagagcacctctgggggcacagcggccctgggcctgcctggtcaaggactacttcctatatactgtctgagcgggctggcaaggcgcatag

SEQ ID NO: 792744 - DNA, 622 bp, Homo sapiens
  misc_feature: 57870.44.38.D05.1.pb.heavy.1.raw 57870
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtccctcggctctcagactgttcatttgcagatacagcgtgttcttggcgtttgtctctggagatggtgaatcggcccttcacggagtccgcgtagcttgtgctactcccatcactattaatacgtgagacccacaccagccccttccctggagcttggcgggacccagtgcatccagtagctactgaaggtgaatccagaggctgcacaggagagtctcagggaccccccaggctgaactaagcctcccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 792745 - DNA, 703 bp, Homo sapiens
  misc_feature: 57873.44.27.C05.1.pb.heavy.1.raw 57873
cgtatcgcctccctcgcgccatcagacagtatatacacgaccggtgctcgatttagacgcgatcgaagggtttggggctgggagacgagcccagcactggaaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgagggctggagtgggtggcaggtgtgtcattcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792746 - DNA, 649 bp, Homo sapiens
  misc_feature: 57874.44.57.F02.1.pb.heavy.1.raw 57874
cgtatcgcgcctccctcgcgccatcagacagtatatacacgaccggtgctcgatttagctcgatatagttgggtttggatgctttctgagagtcaaggacctcctgtgcaagaacatgaagcactgtggtttttcctcctgctggtggcagctccagatgggtcctgtcccaggtgcagctgcaggagtcgggcccaggactggtgaggccttcggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgacgccgccgcggacacggccgtttattttctgtgcgaggcgagactggtctttcaatctatggggccgtgccaccctggtcactgtctcctcagcttccaccaagggccccatcggtcttgccccctggcggccctgctccaggagccacctctggggggccacagcgccctgggctgcgctggtcaaggactacttcctatatactgtctgagcgggctggc

SEQ ID NO: 792747 - DNA, 744 bp, Homo sapiens
  misc_feature: 57876.UNK.UNK.UNK.pb.heavy.1.raw 57876
cgtatcgccctccctcgccgccatcagacagtatatacaccgaccggtggcttcgatttagcactcgcacgttgggggtttggggggagaggagcccagcactcgggattccgaggtgtttccattccggtgatcagcactgaacacagaggactcaccatggagttttggctgagctgggttcctccttgttggactttaaaaggtgtccagtgtgaggtgcggctgatggatgtctggaggaggcttagtccagcctggggggtcccagagactcttcctgtgcagcctctgggctcaccgtcagcagcaactacatgagttggggtccgccaggctccagggaaggggctggagtgggtctcagtcatttatactggtgatttcacatactacgcaggactccgtgaaggcccgattcaccatctccaggggacaattccaggaacacggtttatcttcaaaatgaacaacctggagagggcgacgacacggccgtcctattactgtgcgagacaagtcggcgctcggagtggttattattcgtttgacttctggggcccagggggaacccctgggtcaccgtcgcctccgcctccaccaaggggcccatcggtctttccccctgggcaccctcctccaagagcacctcttctggggcgggcacagcggccctggcgctgcctggtccgaaggactacttgcctatatactgtcctgagcggctggccaagggcgcatagg

SEQ ID NO: 792748 - DNA, 701 bp, Homo sapiens
  misc_feature: 57910.44.55.E11.1.pb.heavy.1.raw 57910
ctatgcgccttgccagcccgctcagacagtatataggaagtagtccttgaccaggcagcccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccaaacccaacgtgcgagtgctaaatcgagcaccggtcgtgtatatactgtctgatggcgcgagggaggcgatacg

SEQ ID NO: 792749 - DNA, 589 bp, Homo sapiens
  misc_feature: 57913.UNK.UNK.UNK.pb.heavy.1.raw 57913
cgtatcgcctccctcgcgccatcagacagtatatacacgaccggtgctccgatttagtgtgagtagtttggggtttgggggaagaggagactgacggtcccactcccaggtacagctggtgcagtctgggctgaggtgaagaagcctggggcctcagtgacaggtctcctgcacggcttctggatacacgttcatcaattatgcatattactgggtgcgacaggccgctggacaagggctggagtggatgggatggatgaagccctatatggcaacacgggcctttgccagaagttccaggcagagttagtatgaccaggagcacctcccaggtacagtctacatggaactgagcagcctgagatctgaggacacggccgtgtatttcgtgcgagagccaccagcacctggcttgacttgtgggccagggaaccgctggtcaccgtctcctcagcctccaccaagggcccatcggtcttccccctggcgccctgctccaggagcacctccgagagcacagcggccctgggctgcctggtcaaggactactttcctatatactgtctgagcgggctggcaaggcgcatag

SEQ ID NO: 792750 - DNA, 715 bp, Homo sapiens
  misc_feature: 57916.UNK.UNK.UNK.pb.heavy.1.raw 57916
cggtatcgctcctcgcgccatcagacagtatatacacgacggtgctcgatttagtatcactcagtcgcggggggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtctggggaggcgtgtccagcctgggaggtcctgagactctcctgtgcagcgtctggattcaccttcagtacctatggcatggcactgggtccgccaggctccaggcaaggggcctggagtgggtggcacttatatggtatgatggaagtaataaatactatgcaccgactccgtgaaggccgattcaccatctccagagacaattccaagaacacgctgtatctgcaaatgaacagcctgagagcccgaggacacggctgtgtattactgtgcggaggacatattgtagtactaccaccgctgctggactactactacggtatggacgtctggcgcaagggaccacggtcaccgtctcctcaggcctcaccaagggccatcggtcttccctggcacgcctcctccaagagcacctctggggcacagcggccctgggctgcctggtcaaggactacttcctatatactgtctgaggcgggctggcaaggcgcatag

SEQ ID NO: 792751 - DNA, 700 bp, Homo sapiens
  misc_feature: 57922.UNK.UNK.UNK.pb.heavy.1.raw 57922
cgtatcgcctccctcgcgccatcagacagtatatacacgaccggtgctcgatttagcactcgccacgttgggtttggggagaggagcccagcactgggattccgaggtgtttccattcggtgatcagcactgaacacagaggactcaccatggagttttggctgagctgggttctccttgttggacttttaaaaggtgtccagtgtgaaggtgcgggctgatggagtctggaggaggcttagtccagcctgggggtccagagactctcctgtgcagcctctggctcaccgtcagcagcaactacatgagttgggtccgccagggctccagggaaggggctggagtgggtctcagtcattatactggtgatttcacatactacgcagactccgtgaagggcccgattcaccatctccagggacaattccaggaacacggtttatcttcaaatgaacaacctggaggcgacgacacggccgtctattactgtgcgagacaagtcggcgctcggagtggttattattcgtttgacttctggggccagggaaccctggtcaccgtcgcctccgcctccaccaagggcccatcggtcttcccctggcacctcctccaagagcacctctggggcacagcggcctgggctggcctggtcaaggactacttcctatatactgtctgagcgggctggcaaggcgcatag

SEQ ID NO: 792752 - DNA, 654 bp, Homo sapiens
  misc_feature: 57928.44.86.H09.1.pb.heavy.1.raw 57928
ctatgcgccttgccagcccgctcagacagtatataggaagtagtccttgaccagggcagccagggccgctgtgcccccagaggtgctcctggagcagggcgccagggggaagaccgatgggcccttggtggaagctgagagacagtgaccagggtgcccacggccccatagattgaaagaccagtctcgcctcgcacagaaataaacggccgtgtccgtggcggtcacggaggtcagtttcagggagaagcggttcatggacgtgtccctcgaaatggtgagacgactctgagggacggagagtagtacgtcgccccagtataatggatgtcaccaatccactccattccctccctggggctgcggatccagccccaagaatgatcagaactgatggaaactccagagacagtgcagatgagagacagggttcccgaaggcctcaccagtcctgggcccgactcctgcagctgcacctgggacaggacccatcctggaagctgccaccagcaggaggaaaaaaccacaggtgcttcatgttcttgcacaggaggtccttgactctcagaaagcatccccaaacccaagtctatagcactaaatcgagcaccggtcgtgtaatatactgtctgatggcgcgagggaggcgatacg

SEQ ID NO: 792753 - DNA, 540 bp, Homo sapiens
  misc_feature: 57937.44.38.D05.1.pb.heavy.1.raw 57937
ctatgcgccttgccagcccgctcagacagtatataggaagtagtccttgaccaggcagccagggccgctgtgcccccagaggtgctcctggagcagggcgccaggggaagaccgatgggcccttggtggaagctgaggagacggtgaccgtggtccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcaggaccccccaaacccaactatcagatactaatcgagcaccggtcgtgtatatactgtctgatggcgcgagggaggcgatacg

SEQ ID NO: 792754 - DNA, 685 bp, Homo sapiens
  misc_feature: 57950.44.72.G06.1.pb.heavy.1.raw 57950
tatgcgccttgcagcccgctcagacagtatataggaagtagtccttgaccaggcagcccagggccgctgtgctctcggaggtgctcctggagcagggcgccagggggaagaccgatgggcccttggtggaggctgaggaacggtgaccagggttccctgacccagtagtcaatgagcacccagcgcctcccgcacaataatacacagccgtgtcctcggactctcagactgttcatttgcagatacgtgagtttcttggcgttgtctctggagatggtgaatcggcccttcacagagtccacatagtgtgtctcagttccatctttcttcatgatggccacccactccagccccttccctggagcctggcggacccagttcatcaaataactactaaaggtgacatccaaggctgcacagagagtctcagggaccccccaggctggaccaagcctcccccagactccaccagttgcacctcacactggacaccttctaaatagcaacaaggaaaacccagctcagtccaattccatggtgagtcctctgtgctcagtgctgatcaccaagtggaaaggccttggagtccagggctaaggctcctctctcccctttcccttgcagtcgtagctaaatcgagcaccggtcgtgtatatactgtctgatggcgcgaggaggcgatacg

SEQ ID NO: 792755 - DNA, 608 bp, Homo sapiens; identical to SEQ ID NO: 792142
  misc_feature: 57956.UNK.UNK.UNK.pb.heavy.1.raw 57956

SEQ ID NO: 792756 - DNA, 614 bp, Homo sapiens
  misc_feature: 57977.44.23.C01.1.pb.heavy.1.raw 57977
ctatgcgccttgccagccccgctcagacaggtatataggaagtagtccttgaccaggcagcccaggccgctgtgcccccagaggtgctcctggagcagggcgcaggggaagaccgatggccctttggtggaagctgaggagacagtgacccagggtgccacggccccatagattgaaagacccagtccgcctcgcacagaaataacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattccctccctgggggctgccgatccaggccccaagaatgatcagaactgatggaaactcagaacagtgcagatgagagacagggttcccgaaggcctcaccagtcctggcccgactcctgcagctgcacctgggacaggacccatctggagctgccaccagcaggaggaaaaaccacaggtgttcaccctgccccaatccctaatcacgtgtactaatcgagcaccggtcgtgtgtatatactgtctgatggcgcgaggaggcgatacg

SEQ ID NO: 792757 - DNA, 701 bp, Homo sapiens
  misc_feature: 57984.44.55.E11.1.pb.heavy.1.raw 57984
ctatgcgccttgccagccgctcagacagtatataggaagtagtccttgaccagcagccagggccgctgtgcccccagagggtgctcttggaggagggtgccaggggcagaccgatggccccttggtggaggcggaggcgacggtgaccagggttcctggccccagaagtcaacgaataataaccactcgagcgccgacttgtccgcacagtaagacgacggtcccgtgtcgtcgcctctcaggttgttcatttgaagattaaccgtgttcctggaattgtccctggagatggaatcggcccttcacgggaggtctgcgtagtatgtgaaatcaccagtataatgactgagacccactccaggccgcccttccctggagcctggcgacccaactatgtagttgctgctgacggtgagccagaggctgcacaggagagtcctctggaccgccccaggctggactaagccctcctccagactcatcagccgcacctcacacctggacaccttttaaaagtccaacaggagaacccagctcagccaaactccatggtgagtcctctgtgttcagtgctgatcaccgaatggaaacaccgcgtcaaatcccagtgctgggctcctctctccaaacccaacgtgcgagtgctaaatcgagcaccggtcgtgtatatactgcccttgatggcgcgagggggcgatacg

SEQ ID NO: 792758 - DNA, 714 bp, Homo sapiens
  misc_feature: 58017.44.70.G04.1.pb.heavy.1.raw 58017
cgtatcgcctcctcgcgcccatcagacagtatatacacgaccggtgctcgatttagtgtagtgtgaagggaaaggggtctgggagaggagcccagcactagaagtcggcgtgtttccgattcggtgatcagcactgaacacagagactcaccatggagtttgggctgagctgggttttcctcgttgctcttttaagaggtgtccactgtcaggtgcacctggtgagtctgggggaggcgtggtccagcctgggaggtccctgagactctcctgtgaagcctctggattagtttcagctggttctggcatgcactgggtccgccaggctccaggcaagggccggagtggttgcagttatagcacatgatggaagtttgaatattattgcagactccgtgaaggccccgattcaccatctccgcagagaacaattcccggaaacattgtgtacttggaaatggtcagcctgaggagtcgaggacgactccgcgctctgtgattactgtgcgagatcgggaggtggtagtagttattaccgcggcgcatgactggggcaggggaccctggtcaccgtctcctcagcctccaccaagggcccatccggtcttcccctggcgccctgctccaggagcacctccgagagcacagcgccctggctgcctggtcaaggactacttcctatatactgtctgagcgggctggcaaggcggcatg

SEQ ID NO: 792759 - DNA, 688 bp, Homo sapiens
  misc_feature: 58057.UNK.UNK.UNK.pb.heavy.1.raw 58057
ctatgcgccttgccgcccgctcagacagtatataggaagtagtccttgaccaggcagcccaggccgctgtgccccagaggtgctcctggagcagggcgccaggggaagaccgatgggcccttggtggaagctgaggtgacaatgaccagggttccctgcccccagatctcaaaggctccatgcgagctgggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggcctgcgcacccagttgatggtataaagtagtggaactggtagtacttccagaggccgtgcaggaaaggtcaccgaggaccaaggttgcggcattctagtcccagactgcaccagttgcaccagggactgacacctgttgctgctgccaccacaaagaggaacctccaggtccagtccatggtgatgagctgtgctcccaggggcttctttagaggaggaatgtggttgttatgtgatgctcccccctgatagagctactaaatcgagcaccggtcgttgtatatactgtctgatggcgcgagggaggcgatacg

SEQ ID NO: 792760 - DNA, 705 bp, Homo sapiens
  misc_feature: 58072.UNK.UNK.UNK.pb.heavy.1.raw 58072
cgtatcgcctccctcgcgccatcagacagtatatacacgacgggtgctcgatttagctgcgtcacgatctctcttggggagctctgagagcggagccccagccccagaattcccaggtgttttcatttggtgatcagcactgaaacagaggactcaccatggagttcgggctgagctgggttttccttgttgttattttacaaggtgtccagagtgaagtgcagttggtggagttccgggggagacttgggtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgcgcgtctgtgaaagccagattcaccctctcaagagatgactttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgaggcggctggcaaggcgcatag

SEQ ID NO: 792761 - DNA, 692 bp, Homo sapiens
  misc_feature: 58096.44.36.D03.1.pb.heavy.1.raw 58096
ctatgcgccttgccagcccgctcagacagtatataggaagtagtccttgaccaggcagccaggcgcgtggctccggaggtgctcctggagcagggcgccagggggaaagaccgatgggcccttggtggaggctgaggagacggtgaccagggttccctgccccagtgacagttcctgatataaacaaacacaataatacattgcccgtgtccctcggtttcaggttagtcattcgcagaatcaatgagttcttgaagtcatctcttgagggggtgaatctggctttcacagacgcgcgtactctgtggtaaagctgcaactttgttttactgcggccaagccactcagccccttccctgggcctggcggacccagtccataatagtgtcactgatggtgaatccagaggcgacacagggagagtctcagggaccctccaggctggacagtctccccccggactccaccaactgcactttcactctggacaccttgtaaaataacaacaaggaaaacccagccagcccgaactccatggtgagtcctctgtgttcagtgctgatcaccaatgaaaacacctgggaattctgggctggggctccgctctcagagctccccaagagagatcgtgacgcagctaatcgagcaccggtcgtgtatatactgtctggatggcgcgaggaggcgatacg

SEQ ID NO: 792762 - DNA, 617 bp, Homo sapiens
  misc_feature: 58114.44.23.C01.1.pb.heavy.1.raw 58114
ctatgcgccttgccagcccgctcagcagtatataggaagtagtccttgaccaggcagcccagggccgctgtgccccagaggtgctcctggagcagggcgcaggggaagaccgatgggcccttggtggaagctgaggagacagtgaccagggtgccacggccccatagattgaaagaccagtctcgcctcgcacagaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctggggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 792763 - DNA, 708 bp, Homo sapiens
  misc_feature: 58119.UNK.UNK.UNK.pb.heavy.1.raw 58119
ctatgcgccttgccagcccgctcagacagtatataggaagtagtccttgaccaggcagcccagggccgctgtgctctcggaggtgctcctgggagcagggcgccagggaagaccgatgggcccttggtggaggctgaggagacggtgaccagggttccccggcccagtagtcaaaaccagccactgaccaagtggccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggaccccccccgctgtaccaagcctccccagactccaccagccgcacctcacagtggacaccttctaaaatagcaacaaggaaaacccagcgcagccccaactccatggtgagtcctctgtgttcagtgctgatcaccaagtggaaatgccttggaatccaggctaaggcacctctctgagagctcccaagagagatcgtgacgccagctaaatcgagcaccggtcgtgtatatactgtctgatggcgcgagggaggcgatacg

SEQ ID NO: 792764 - DNA, 861 bp, Homo sapiens
  misc_feature: 58121.UNK.UNK.UNK.pb.heavy.1.raw 58121
ctaatgcgccttgaccaggcccggctccagacagtatatataaggaagtagtccttgaccaaggccagccccggccgctgtggctctcggagggtgctccttggagcagggcgccaggggggaagacggatgggccctttgttctcggcgtggaggctgaggagagcggtggccagggagttcccctggccccaaagctacgtcaacgctggtgaccgtcgtgccgaagggcagtgctgtctggcacagaataatacgacagagcggcgtgtacacgatcaccttgtgagggtaggtacacatttggggcagatgaccgaagtgtgcttcctggatattgtcgtctctgagagcgcgttgaatcggctccttctccggaagtctccgtatgttggtttcttcaattccatctatcctggatataattgcccacccactccagaccccttgcctgcgagcctggcggacccagtggcatgggcataggtccactcgagatgataatccagagctggcacaggagagttctcagggagttcccagcggccgtgggccggctcctccgttataccccaagagactcccacctagcactgcaaccctgaacactggccacctcttaaaagagcaagacggaaaacacccatctcagcccaaaattccatggtgaagttccgctctgtgttcagtgatgatcaccgatggaaagaaaacacggcgacttccagtgctgggctcgtctccccccctgagcgtaagagctaaatcgaggcaccgtccgtgtcgtatataatgtctaatggcgtgaggaaggcgataggcataatgattcacgatactgatcatttctagatttttttt

SEQ ID NO: 792765 - DNA, 607 bp, Homo sapiens
  misc_feature: 58128.44.36.D03.1.pb.heavy.1.raw 58128
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggcctgggctgcctggtcaaggactacttcctatatactgtctgagcgggctggcaaggcgcatag

SEQ ID NO: 792766 - DNA, 712 bp, Homo sapiens
  misc_feature: 58131.UNK.UNK.UNK.pb.heavy.1.raw 58131
cgtatcgcctccctcgcgccatcagacagtatatacacgacccggtgctctatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggggctcaccgtcagcagcaactacatgagttgggtccgccaggctccaggaaggggctggagtgggttctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaaagtcggcgctcggagtggttattattcgtttgacttctggggccagggaaccctggtcaccgtccgcctccgcctccaccaaggggtcccatcggtcttcccctggcaccctcctccaagagcacctctgggggcacagcggccctggggctgcctggtcaaggactacttcctatatactgtctgagcggggctggcaaggcgcatag

SEQ ID NO: 792767 - DNA, 699 bp, Homo sapiens
  misc_feature: 58162.UNK.UNK.UNK.pb.heavy.1.raw 58162
gtatcgcgcctccctcgcgccatcagacagtatatacacgacggggtgctcgattagctgcgtcacgatctctcttggggagctctgagagcggagcccagcccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtcctgagactctcctgtgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctcaccaagggccatcggtcttccccctggcgccctgctccaggagcacctccgagagcacagcggccctggctggcctggtcaaggactacttcctatatactgtctgagcgggctggcaaggcgcatag

SEQ ID NO: 792768 - DNA, 656 bp, Homo sapiens
  misc_feature: 58179.44.86.H09.1.pb.heavy.1.raw 58179
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcacccctggtcactgtctcctcagcttccaccaagggcccatcggtcttccccctggcgccctgctccaggagcacctctgggggcacagcggccctgggctgcctggtcaaggactacttcctatatactgtctgagcgggctggcaagggcgcatag

SEQ ID NO: 792769 - DNA, 679 bp, Homo sapiens
  misc_feature: 58185.44.35.D02.1.pb.heavy.1.raw 58185
cagcccgctcagacagtatataggaagtagtccttgaccaggcagcccagggccgctgtgcccccagaggtgctcttgaggagggtgccagggggggaagaccgatgggcccttggtggaggctgaggagacggtgaccagggttcccctggcccagggtcgaggccagttcgcccccccgttcctctactgtatcgataggaatctctcgcaccaataatcatacggccgtgtccgcgggcggtcacagaagtcaatttcagggagaactggttcttgacctgtctagtgacatggtgactcgactccttgagggccggggttgtagttggtgctgccactgttatagatgcgcccaatccactccagtcccttcccggcggactgccgcagcccaactccaataataactactgatgtaacaccagagacattgcaggtgagggagcagggtcttcccgaaggcttcacccgtcctgggcccgactcctgcagctgcacctcggacacgacccatctgggaggtgccaccaggaggaggaagaaccacaggtgttttcatgttcttgtgcagggaggcccatgagttctcagaaagtatccccaaaccccaactatcgtgtgctaaatcgagcaccggtcgtgtataactgtctgatggcgcgagggaggcgatacg

SEQ ID NO: 792770 - DNA, 695 bp, Homo sapiens
  misc_feature: 58203.44.36.D03.1.pb.heavy.1.raw 58203
cgtatcgcctcctcgcgccatcagacagtatatacacgaccggtgctcgatttagctgcgtcacgatctctctgggagctctgagagcggagccccagccccagaattcccaggtgtttttcatttggtgatcagcactgaacacagaggactcaccatggagttcgggctgagctgggttttcctgttgttattttacaaggtgtccagagtgaagtgcagttggtggagtccgggggagacttggtccagcctggagggtcctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggccaggaaccctggtcaccgtctcctcagcctcaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 792771 - DNA, 697 bp, Homo sapiens
  misc_feature: 58219.44.74.G08.1.pb.heavy.1.raw 58219
ctatgcgccttgccagcccgctcagacagtatataggaaagtagtccttgaccaggcagcccagggccgctgtgccccagaggtgctcctggaagccagggcgccagggggaagaccgatgggcccttggtggaagctgaggtgacaatgaccagggttccctgcccccagatctcaaagggctccatgcgagctgggggtacggacctctcgcacagtagtagacggccgtggttcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggcctgcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccagggcttctttagaggaggaatgtggttgttatggatgctccccctgatagagctactaaatcgagcaccggtcgtgtatatactgtctgatggccgcgagggaggcgatacg

SEQ ID NO: 792772 - DNA, 655 bp, Homo sapiens
  misc_feature: 58248.44.86.H09.1.pb.heavy.1.raw 58248
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 792773 - DNA, 708 bp, Homo sapiens
  misc_feature: 58255.44.36.D03.1.pb.heavy.1.raw 58255
cgtatcgcctccctcgcggccatcagacagtatatacacgaccggtgctcgatttagctgcgtcacgatctctcttgggagctctcagagaggtgccttagcctggattccaaggcatttccacttggtgatcagcactgaacacagaggactcacatggagttggggctgcgctgggttttccttgttgctattttagaaggtgtccactgtgaggtgcgggctggtggagtctgggaggcttgtacagcgggggggtccctgagactctctgtgcagctctggattcatcttcgtgactatgcccatgaacgggtccgccaggctccagggaaggggctggagtgggtttcatatgttaatattgctgggagataccacctactacgcagactctgtgaagggccgattcaccaattccagggacaatgccaagaactcactgtatctggaaatgaacagcctgagaacgaggacacggctgtctacttctgttcgagagaatcgggccacttggtcagtggctggttttgactactggggccggggaaccctggtcaccgtctccctcagcctccaccaagggcccatcggtcttccccctggcgccctgctccaggaagcacctcggagccacagcggcctgggctgcctggtccaaggactactcctctatatctgtctgagcgggctggcaagggcgcatag

SEQ ID NO: 792774 - DNA, 617 bp, Homo sapiens
  misc_feature: 58261.44.38.D05.1.pb.heavy.1.raw 58261
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactccatcactattaatacgtgagacccaccagccccttccctggagcttggcggacccagtgcatccagtagctactgaaggtgaatccagaggctgcacaggagagtctcagggaccccccaggctgaactaagcctcccccggactccaccagctgcacctcacactggacaccttttaaaatagcaacaaggaaaacccagctatcagatactaaatcgagcaccggtcgtggtatatactgtctgatggcgcgagggaggcgatacg

SEQ ID NO: 792775 - DNA, 680 bp, Homo sapiens
  misc_feature: 58263.44.45.E01.1.pb.heavy.1.raw 58263
ctatgcgccttgccagcccgctcagacagtatataggaagtagtccttgaccaggcagccagggccgctgtgctctcggaggtgctcctggagcagggcgccagggggaagaccgatgggccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggccggacccagtgcatggcagagtcactgaaactgagtccggacgcaacacaggagagtctcagggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctccagcccctttcccttactgactcactaatcgagcaccggtcgtgtatatactgtctgatggcggcgagggaggcgatacg

SEQ ID NO: 792776 - DNA, 562 bp, Homo sapiens
  misc_feature: 58281.44.78.H01.1.pb.heavy.1.raw 58281
cgtatcgcctccctcgcgccatcagacagtatatacacgaccggtgctcgatttagtgtgagtagtttgggtttggtgccgaagttgctggaggtcacggtcaccacgctgctgaggtgaagaagcctgggcctcagtgacagtctcctgcacggcttctggatacacgttcatcaattatgatattaactgggtgccgacaggccgctggacaaggctggagtggatgggatggatgaagccctatagtggcaacacgggcttggcccagaagttccaaggcagagttagtatgacaggagcacctccccaggtacgtctacatggaactgagcagcctgagatctgaggacacggccgtgtatttctgtgcgagagccaccagcacctggcttgacttgtggggccagggaaccctggtcacccgtccctcagcctccaccaaggcccatcggtcttcccctggcgcctgctccaggagcacctccgagagcacagcggcctgggctgcctggtcaaggactacttcctatatactgtctgcgggcggcaaggcgcatag

SEQ ID NO: 792777 - DNA, 713 bp, Homo sapiens
  misc_feature: 58284.44.56.F01.1.pb.heavy.1.raw 58284
cgtatcgcccctccctgcgccatcaggacagtatatacacgaccggtgctcgatttagcagacgtctgaacacaacaaaaggggagctctgggagaggagccccagccgtgagattcccaggagtttccacttggtgatcagcactgagcacagaccaccaaccatggagtttgggctatcttgattttccttgttagtttttttagaagtgtccagtgcgagggggcgactggcgagtcggcgggggcttgggcacagccgcaggcgtctctgagactctcctgtgtagtctcagattcagtcttagtgattatcacttggcctgggtccgtcaggctccaggaaggggcttgagtgattcacttttcggtcagaatgaaacgttatggtggaagtaaagagtacgcgcggtctgtgaaggaagattcaccgttctcagggatgactccaacagtgtggccatttacaaatgagcaacctggacccgacgacacaggcgtctattactgcgccaagcgatcctggacgtcgatgcatttgatatttggggccagggcaatggtcacgcgtcctttcagcttccaccaagggcccatggtcttccccctggcgccctgctccaggagcacctctgggggcaccagcggccctgggctgcctggtcaaggactacttctatatactgtctgaggcggctggcaaggcgcattag

SEQ ID NO: 792778 - DNA, 1314 bp, Homo sapiens
  misc_feature: 58328.UNK.UNK.UNK.pb.heavy.1.raw 58328
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgacccagggtgccacggccccatagattgaaagaccagtctcgcctcgcacagaaataacggccgtgtccgcggcggtcacggaggtcagtttcagggagaagcggtcatggacgtgtcctcgaaatggtgagacgactcttgagggacggagagtagtacgtcgcccagtataatggatgtcaccaatcccactccattcccctccctgggggctgcggatccagccccaagaatgatcagaactgatggaaaactccagagacagtgcagatgagagaccagggttcccgaaggcctcaccagtcctgggcccgactcctgcagctgcacctggacaggacccatctgggagctgccccagcaggaggaaaaaccacaggtgttcaccctgccccaatccctaatcacgtgtactaaatcgagcaccgtcgtgtatatactgtctgatggcgcgagggaggcgatacgcgtatcgcctccctcgcgccatcagacagtatatacacgaccggtgctcgatagcctgcgtcacgatctctctggggagctctggagcggagcccagcccagaattcccaggtgttttcattggtgatcagcaactgaacacagaggactcaccatggagttcgggctgagctggttttccttgttgttattttacaaggtgtccagagtgaagtgcagttggggagtccgggggagacttggtccagcctggagggtccctgagactctcctgtgtcgcctctggattcaccatcagtgaccactatatggactgggtccgccaggctccagggaagggggctggagtggcttggccgcagtaaaacaaagttgccagctttatcacagagtacgccggccgtctgtgaaagccagattcaccctctcaagagatgacttcaagaactcattgattctgcgaatgactaaccttgaaaacccgaggacacgggcatgtattattgtgttgtgtttatatcaggaactgtcactgggccagggaaccctggtcaccgtctcctcagcctccacaagggcccatcgtcttcccctggcgccctgctccaggagcacctccgagagcacagcggccctgggctgcctggtcaaggactacttcctatatactgtctgagcgggctggcaaggcgcatag

SEQ ID NO: 792779 - DNA, 694 bp, Homo sapiens
  misc_feature: 58329.44.36.D03.1.pb.heavy.1.raw 58329
cgtatcgcctccctcgcgccatcagacagtatatacacgaccggtgctcgattagctgcgtcacgatctctctggggagctctgagagcggagccccagccccagaattcccagtgttttcattttggtgatcagcactgaacacagaggactcaccatggagttcgggctgagctggttttccttgttgttattttacaaggtgtccagagtgaagtgcagttgggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggccatcggtcttcccctggcgccctgctccaggagcactccgagagcacagcggccctggctgcctggtcaaggactacttcctatatactgtctgagcgggctggcaaggcgcatag

SEQ ID NO: 792780 - DNA, 667 bp, Homo sapiens
  misc_feature: 58367.44.71.G05.1.pb.heavy.1.raw 58367
cgtatcgcctccctcgcgccatcagacagtatatacacgaccggtgctcgatttagtgtcgtcgcaagagagaggggcccagccctgggactgaacagagagaactcaccatggagtttgggctgagctggctttttcttgtggctgttttaaaaggtgtccagtgtgaagtgcagctgttggagtcgggggaggcttggtacagccggggggtccctgacactctcctgtgcagcctctggattcgcctttaatacctatgccatgatctgggtccgtcaggcccagggagggctggagtgggtctcatccattactggtggtagtgccacaaatgtcgcagactccgtgaagggccgcttcatcgtctccagggacaattccagaatacggtgtttctgcagatgaagagcctgcgagtggacgacacggccctttattactgtgccagagggtcgcagaagttacaacaatacaagtattactactacatggacgtctggggcaaagggaccccggtcaccgtctcctcagcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 792781 - DNA, 720 bp, Homo sapiens
  misc_feature: 58384.UNK.UNK.UNK.pb.heavy.1.raw 58384
ctatgcgcctgccagcccgctcagacagtatataggaagtagtccttgaccaggcagcccagggccgctgtgcccccagaggtgctcctggagcagggcgccagggggaagaccgatgggcccttggtgggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaaccactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacaacaggagagtctcagagaccgccctggctgtgccaagcccccccgactccgccagtcgcccctcgcactgacacctttctaaaaaaaactacaaggaaaatcaagattagcccaaactccatggttggtggtctgtgctcagtgcgctcacggtcaccaagggaaactcctggaaatctcacggctgggctcctctcccagagctcccctttgtgtgttcagacgtctgctaatcgagcaccggttcgtgtatatactgtctgatggcgcgagggagggcgatacg

SEQ ID NO: 792782 - DNA, 698 bp, Homo sapiens
  misc_feature: 58413.44.55.E11.1.pb.heavy.1.raw 58413
ctatgcgccttgccagcccgctcagacagtatataggaagtagtccttgaccaggcagcccagggccgctgtgcccccagaggtgctcttggaggaggtgccaggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgtcctggaattgtccctggagatggtgaatcggcccttcacggagtctgcgtagtatgtgaaatcaccagtataaatgactgagacccactccagccccttccctggagcctggcgacccaactcatgtagttgctgctgacggtgagcccagaggctgcacaggagagtctctgggaccccccaggctggactaagcctcctccagactccatcagccgcacctcacactggacacctttaaaagtccaacaaggagaacccagctcagccaaaactccatggtgagtcctctgtgttcagtgctgatcacgaatggaaacacctcggaatccagtgctgggctcctctccccccccaaacccaacgtgcgagtgctaaatcgagcaccggtcgtgtatatactgtctgatggcgcgaggaggcgatacg

SEQ ID NO: 792783 - DNA, 686 bp, Homo sapiens
  misc_feature: 58419.44.45.E01.1.pb.heavy.1.raw 58419
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtgggcagtcatctggtctgatggaagtaaagaatactatggaaactccgtgaagggccgattctccgtctccagagacaattccaagaacaccgtgtatctacaaatgaaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactactttcctatatactgtctgagcgggctggcaaggcgcatag

SEQ ID NO: 792784 - DNA, 737 bp, Homo sapiens
  misc_feature: 58424.UNK.UNK.UNK.pb.heavy.1.raw 58424
ctatgcgccttgccagcccgctcagacagtatataggaagtgagtccgcttgaccaggcagccagggccgctgtgccgccagaggtgctcttggaggagggtgccagggggaagaccgatgggcccggtggaggctgaggagcgggtgaccgtggtccttggcccagacgtcactaccgtcagtcaggtccagcaggtggtagtactacaatatgtcctcgcaccagtaatacaccagcccgtgtcctcggctctcaggctgttcatttgcagatacagcgtgttcttggaattgtctctggagatggtgaatcggcccttcacggagtctgcatagtattgtattacttccatcataccatataagtgcccacccactccagccccttgcctggcagcctggcggacccagtgcatgccataggtactgaaggtggaatccagcacgcctgcacaggagagtctcagggacctcccaggctggaccacgcctcccccagactccaccagcctgcacctgacactggaacagcctctttaaaagagcaacgaggaaaacccagctcagcccaaactccatggtgagtcctctggtgttcagtgctgatcaccgaatggaaacaccggccgacttctagtgctgggctcctctcccagagctccccgcgactgagtgatactaaaatcgagcaccgcgtcgtgtatatactgtctgatggcgccgagggagcgatacg

SEQ ID NO: 792785 - DNA, 667 bp, Homo sapiens
  misc_feature: 58431.44.6.A06.1.pb.heavy.1.raw 58431
ctatgcgccttgccagccgctcagacagtatataggaagtagtccttgaccaggcagcccaggccgctgtgcccccagaggtgctcctggagcagggcgccagggggaagacgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaagaggatgattccacccatccactcaagcccttgtccagggcctggcgcaccagttgatggtataagtagtggaactggtagtacttccagaggccgtgcaggaagggtcaccgaggaccaaggttgcggcattctagtcccagactgcaccagttgcaccagggactggacacctgtgctgctgccaccacaaagaggaaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 792786 - DNA, 722 bp, Homo sapiens
  misc_feature: 58439.44.39.D06.1.pb.heavy.1.raw 58439
cgtatcgcctccctcgcgccatcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccgggaggtcctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcg

SEQ ID NO: 792787 - DNA, 705 bp, Homo sapiens
  misc_feature: 58440.44.27.C05.1.pb.heavy.1.raw 58440
ctatgcgccttgcagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaaataccacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggaccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 792788 - DNA, 686 bp, Homo sapiens
  misc_feature: 58446.UNK.UNK.UNK.pb.heavy.1.raw 58446
cgtatcgcctcctccgccccatcagacagtatatacaccgaccggtgctcgatttagcacacgatagttgggttttggggatacttctgagactcatgggcctcctgcacaagaaacatgaaacacctgtggttcttctcctcctggtggcacctcccagatgggtcgtgtccgaggtgcagctgcaggagtcgggccccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtccaagaaaccagttcttccctgaaattgacttctgtgaccgccgcggacacggccgtatatttattgttggcgagagattcctatcgatacagtagagacgggggggcgaactggctcgacccctgggccagggaaccctggtcaccgtctcctcagcctccaccaagggcccatcggtcttcccctggcaccctcctccaagagcacctctgggggcacagcggccctgggctgcctggttcaaggactacttcctatatactgtctgagcgggctggcaaaggcgcatag

SEQ ID NO: 792789 - DNA, 666 bp, Homo sapiens
  misc_feature: 58452.44.12.B01.1.pb.heavy.1.raw 58452
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792790 - DNA, 692 bp, Homo sapiens
  misc_feature: 58460.44.36.D03.1.pb.heavy.1.raw 58460
ctatgcgccttgccaggccgctcagacagtatataggaagtagtcttgaccaggcagcagggccgctgtgctctcgaggtgctcctggagcagggcgccaggggaagaccgatggcccttggtggagctgaggagacggtgaccagggttccctggccccagtggacagttcctgatataaacacaacacaataatacatgcccgtgtcctcgttttcaggttagtcattcgcagaatcaatgagtcttgaagtcatctcttgagagggtgaatctggcttcacagacgcggcgtactctgtgataaagctggcaacttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaacccagctcagcccgaactccatggtgagtcctctgtgttcagtgctgatcaccaaatgaaaacacctgggaattctgggccctggggctccgctctcagagctcccaagagagatcgtgacgcagctaaatcgagcaccggtcgtgtatatactgtctgatggcgcgagggaggcgatacg

SEQ ID NO: 792791 - DNA, 711 bp, Homo sapiens
  misc_feature: 58478.44.62.F07.1.pb.heavy.1.raw 58478
ctatgcgccttgccagcccgctcagacagtatataggaagtagtccttgaccaggcagcccaggggccgctgtgctctcggaggtgctcctggagcagggcgccaggggaagaccgatgggcccttggtggaggctgaagagacggtcaccactgtccccccggcccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctcctggagcccggcggacccaggtcatgccataggcactaaaggtgaatccagaggccgcacaggagagggtcagggacctccaggccgaatcaggcccccccagactccaacaactgcacttcacacacgacacccttttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggccgcgagggaggcgatacg

SEQ ID NO: 792792 - DNA, 696 bp, Homo sapiens
  misc_feature: 58484.44.27.C05.1.pb.heavy.1.raw 58484
ctatgcgccttgccagccgctcagacagtatatagggaagtagtccttgaccaggcagcccagggccgctgtgctctcggaggtgctcctggagcagggcgccagggggaagaccgatgggcccttggtggaggccgaggagacggtgaccagggttccctggccccaggcgtcgatgaaccgattttggaaacagatagtctcgcacaaaaatacacggccgtgtcctgaggtctcaggctgttcatttgaagagacactgtgtttctcggaattgtctctggagatggtgaatcggccctcaacggaatcaccgtagacttgatttcctccatgaaatgacacacctgccacccactccagcctcgcctggagcctggcgaccactgcatattccaattatcgaaggtgaatccagaggctgcacagagagtctcagggaccccccctactggggcacgcctccccagactccacgaattgcacctgacacatgacacctcttaagagggcaacgaggaaaacccagctcagcccaaaactccatgtgagtcctctgtgttcagtgatgatcaccgagtggaaacaccggcgacttccagtgctgggctcgtctcccaggcccaaccttcgatcgcgtctaaatcgagcaccggtcgtgtatatactgtctgatggcgcgagggaggcgatacg

SEQ ID NO: 792793 - DNA, 664 bp, Homo sapiens
  misc_feature: 58492.UNK.UNK.UNK.pb.heavy.1.raw 58492
cgtatcgcctcctcgcgccatcagacagtaaatatacacgaccggtgctcgattttagtatgtagattcgcgcggggcttttctgagagtcatggacctcctgtgcaagaaacatgaagcacctgtgttcttttcctcctgctggtggcggctccagatgggtcctgtcccagctgcagctgcaggagttcgggcccaggactggtgaagccttcggagaccctgtccttcctgcactgtctctggtggctccatcagcagtagtagttactactggggctggatccgcagccccagggaaggggcctggagtggattgggaagtatctattatagtgggacacctactacaacccgtcctcaagagtcgagtccaccatataattagacacgtcagaaaccagttccctgaagctgagctctgtgaccgccgcggacacggcgtgtatttacgtgcggagtagggcagttcgtcaccaactacttgacccactgggggccagggaaccctggtcaccgtctcctcagcctccaccaagggcccatcggtcttccccctggcaccctcctccaagagcacctctgggggcacagcggccctgggctgcctggtcaaggactactttcctatatactggtctgagcgggctggcaaggcgcatag

SEQ ID NO: 792794 - DNA, 678 bp, Homo sapiens
  misc_feature: 58520.UNK.UNK.UNK.pb.heavy.1.raw 58520
ctatgcgccttgccagcccgctcagacagttatataggaagtagtccttgaccaggcagcccaggccgctgtgctctcggaggtgctcctggagcagggcgccagggggaagaccgatggcccttggtggaggctgaggagacggtgaccagggctccctgccccagtagaacgatgggctcgtacaataaatagagagccgagtctcggctctcaattgttcatttgtagatacacggtgttcttggaattgtctctggagacggagaatcggcccttcacggagtttccatagtattctttacttccatcagaccagatgactgccacccactcagccccttgcctggagcctggcggacccagtgcatggcagagtcactgaaactgagtccggacgcaaacacaggagagtctcagggacgtcccaggctggaccacgcctcccagaaactccaccagctgaacctgacactgacacctcttaaaagagcaacggaggaaaacccagctcagcccaaactccatggtgagtcctctgtgttcagtgctgatcaccgaatggaaacaccgccgattctagtgctgggctcctctcccagcccttccttactgactcactaaatcgagccaccggtcgtgtatattactgtctgatggcgcgagggaggcgatacg

SEQ ID NO: 792795 - DNA, 596 bp, Homo sapiens
  misc_feature: 58534.UNK.UNK.UNK.pb.heavy.1.raw 58534
ctatgcgccttgccagcccgctcagacagtatataggaagtagtccttgaccaggcagcccagggcgctgtgcccagaggtgctcctggagcaggcgccagggaagaccgatgggcccttgtggaagctgaggagacagtgaccagggtgccacggcccatagattgaaagaccagtctcgcctcgcacagaaataaacggccgtgtccgcggcgtcacggaggtcagtttcagggagaagcggttcatgacgtgtccctcgaaatggtgagacgactcttgagggacggagagtagtacgtcgcccagtataatggatgtcaccaatccactccattccctcctggggctgccggatccagcccaagaatgatcagaactgatggaaactccagagacagtgcagatgaagacaggttccgaaggcctcaccagtcctgggccgactcctgcagctgcacctggacaggaccatctgggagctgccaccagcaggaggaaaaacacaggtgttcacctgccccaatccctaatcacgtgtactaaatcgagcaccgtcgtgtatatactgtctgatggcgcgaggaggcgatacg

SEQ ID NO: 792796 - DNA, 715 bp, Homo sapiens
  misc_feature: 58550.44.33.C11.1.pb.heavy.1.raw 58550
cgtatcgcctcctcgcgccatcagacagtatatacacgaccggtgctcgatttagagtgagctcgttggtttgggagctctgggagaggagcccaagcaccagaagtcggcgtgtttccagtcggtgatcagcaccgaacacagaggactcaccatggagtttggggctgacctggtttttcctcgttgccctttaagaggtgtccagtgtcaggtgaagctggtggagtctgggggagccgtggtccagcctgggaggtccctgagactctcctgtgtagcgttctggattcaccttcaacaagacatggcatgcactgggtccgccaggctccaggcaagggactggagtgggtggcacttatatggtatgatgggaagtaataaatatatgtagattccgtgaagggccgatcaaccatctccagagacaattcgaagaacacacttatctggaaaatgaatagcctgagagccgaggacacggctgtctactactgtgcgagagatggctcgtgggatacagatatgacatgctctactccaatgtatggacgcctggggccaagggaccacgtcgccgtctctcagcctccaccaagggccatcgtcttcccctggcacctctccaagagcactctggggccagcggccctgggctgcctgtcaaggactacttcctatatactgtctgagcgggctggcaggcgcatag

SEQ ID NO: 792797 - DNA, 655 bp, Homo sapiens
  misc_feature: 58590.44.29.C07.1.pb.heavy.1.raw 58590
cgtatcgcctccctcgcgccatcagacagtatatacacgaccggtgctcgatttagagtgctacgaagggaaagggggactcctgtgccccaccatggacacactttgctccacgctcctgctgctgaccatcccttcatgggtctgtccagatcaccttgaaggagtctggtcctacgctggtgaagcccacacagaccctcacgctgacctgcaacctctctgggttctcactcaggagtgatggagcgattgtgggctgggtccgtcagcccccaggaaaggccctggagtggcttgcactcattattgggatgatgataggcgctacagtccatctctgaagagcagactctccatcaccggagacgcctccaatacgcaggtgatccttagagtggccaacatggccctgcggacacagccacatactactgcgcacacatgatcaactattataaaagtggtggttatgtgagtggcttttgatatctggggcaagggacaatggtcaccgtctcttcagcctccaccaagggccatcggtcttcctggcgccctgctccaggagcacctccgagagcacagcggccctggctgcctggtcaaggactacttcctatatactgtctgagcgggctggcaaggcgcatag

SEQ ID NO: 792798 - DNA, 625 bp, Homo sapiens
  misc_feature: 58607.44.23.C01.1.pb.heavy.1.raw 58607
tcgcctccctcgcgccatcagacagtatatacacgaccggtgctcgatttagtacacgtgattagggattgggggcagggtgaacacctgtggttttttcctcctgctggtggcagctcccagatgggtcctgtcccaggtgcagctgcaggaggtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcacccctggtcactgtctcctcagcttccaccaagggcccatcggtcttcccctggcgccctgctccaggagcacctctgggggcacagcggcgtcctggggctgcctggtccaaggactacttcctatatactgtctgagcgggctggcaagggcgcatag

SEQ ID NO: 792799 - DNA, 657 bp, Homo sapiens
  misc_feature: 58657.UNK.UNK.UNK.pb.heavy.1.raw 58657
cgtatcgcctccctcgcgccatcagacagtatatacagaccggtggctcgatttagatctactgacaaccacattcctcctctaagaagccctgggagcacagcgcatcaccatggactggacctggagttcctctttgtggtggcagcagcaacaggtgtccagccctggtgcaacgtgtcagtctgggactagaatgccgcaacttggtcctcggtgaccctttcctgcacggctctgaagtactaccagttccactacttataccatcaactgggcggcgcagcccctggacaagggcttgagtggatggtggaatcatcctctttttggctcacgtcacctacgccacgagacttccggggcagaattacgattaccgcggacaagtcacagacacagtctccatgacaatgagttctttgaaatccgacgacacggccgtctactactgtgcgagaggtccgtaccccagctcgcatggagccttgagatctgggggcagggaacccctggtcattggtcacctcagcttccaccaaggcccatcggtcttccctggcgccctgctccaggcactctggggggcacagcggccctggctgcctggtcaagactacttcctaatactgtctgagcggctggcaaggcgcatag

SEQ ID NO: 792800 - DNA, 661 bp, Homo sapiens
  misc_feature: 58668.44.67.G01.1.pb.heavy.1.raw 58668
agtccttgaccaggcagcccaggccgctgtgcccccagaggtgctcttggaggaggtgccaggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaatatgtatactctaaatcgagcaccggtcgtgtatatactgtctgatggcgccgaggaggcgatacg

SEQ ID NO: 792801 - DNA, 725 bp, Homo sapiens
  misc_feature: 58677.UNK.UNK.UNK.pb.heavy.1.raw 58677
cgtatcgcctccctcgcgccatcagacagtatatacacgacggtgctcgatttagagtgagctcgttgggtttgggagctctgggagaggagcccagcaccagaagtcggcggtgtttccagtcggtgatcagcaccgaacacagaggactcaccatggagtttgggctgacctgggtttttcctcgttgctcttttaagaggtgtccagtgtcaggtgaagctggtggagtctggggaggcgtggtccagcctggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgctggggccaagggaccacggtcgccgtctcctcagcctccccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792802 - DNA, 675 bp, Homo sapiens
  misc_feature: 58697.UNK.UNK.UNK.pb.heavy.1.raw 58697
ctattgcgccttgccagcccgctcagacagtaatataggaaaagtagtccttgaccaggcagcccagggccgctgtgcccccagaggtgctcctggagcagggcggccagggggaagaccgatgggcccttggtggaagctgaggagacagtgaccagggtgccacggccccatagattgaaaagaccagtctcgcctcgcacagaataaaccggccgtgtccgcggcggtcacggaaggtcagtttcagggagaagccggttcatggacgtgtcccctcgaaatggtgagacgactccttgagggacggagagtagtacgtcgcccccagtataatggatgtcaccaatccactccattcccctccctgggggctgccggatccagccccaagaatgatcagaactgatggaaactccaagagacagtgcagaatgagagacagggttcccgaaggcctcaccagtcctgggcccgacttcctgcagctgcacctggggacaggacccatctgggaagctgccaccagcaggaggaaaaaaccacaggtgcttcatgttcttgcacaggaggtccttgactctcagaaagcatccccaaacccaagtctatagcaactaaatcgagcaccgggtcgtgtatatactgtctgatggcgccgagggaggcgatacg

SEQ ID NO: 792803 - DNA, 701 bp, Homo sapiens
  misc_feature: 58705.44.55.E11.1.pb.heavy.1.raw 58705
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttcccccctggcacctcctccaagagcacctctgggggcacagcggccctgggctgcctggtcaaggactacttcctatatactgtctgagcgggctggcaaggcgcatag

SEQ ID NO: 792804 - DNA, 703 bp, Homo sapiens
  misc_feature: 58708.44.36.D03.1.pb.heavy.1.raw 58708
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctggggctccgctctcagagctccccaagagagatcgtgacgcagctaaatcgagcaccggtcgtgtatatactgtctgatggcgcgagggaggcgatacg

SEQ ID NO: 792805 - DNA, 609 bp, Homo sapiens
  misc_feature: 58715.44.36.D03.1.pb.heavy.1.raw 58715
cgtatcgcctccctcgcgccatcagacagtatatacacgaccggtgctcgattttagctgcgtcacgatctctcttgggtcttgtcccaggtcaccttgaaggagtctggtcctgtgctggtgaaacccacagagaccctcacgctgacctgcaccatctctggtttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtcttttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792806 - DNA, 679 bp, Homo sapiens
  misc_feature: 58717.44.53.E09.1.pb.heavy.1.raw 58717
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtcagtgtgaggtgcagttggtggagtctggggaggtttggtaaagcctgggagtcccttagactctcctgtgcagcctctggattcactttcagtaacgcctggatgacctgggtccgccaggctccagggaaggggctgagtgggttggccgtattagaaccaagctgacggtgggacagcagactacgctgcacccggtgaaaggcagattcaccatctcaagagatgattcaaagatacgtgtctctgcagatgaacagcctgaacaccgaggacacagccgtctattactgtctgggatggtttcattcgggccagggaacgcctggtcaccgtctcctcagcctccaccaagggcccatcggtcttccccctggcgccctgctccaggagcacctccgagagcacagcggccctgggctgcctggtcaaggactacttccctatatactgtctgagcgggctggcaaggcgcatag

SEQ ID NO: 792807 - DNA, 654 bp, Homo sapiens
  misc_feature: 58720.44.86.H09.1.pb.heavy.1.raw 58720
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgaggacggagagtagtacgtcgccccagtataatggatgtcaccaatccactccattcccctccctgggggcctgccggatccagccccaagaatgatcagaactgatggaaactccagagacagtgcagatgagagacagggttcccgaaggcctcaccagtcctgggcccgactcctgcagctgcacctgggacaggaccatctgggagctgccaccagcaggaggaaaaaccacaggtgcttcatgttcttgccacaggaggtccttgactctcagaaagcatccccaaacccaagtctatagcactaaatcgagcaccggtcgtgatagtatagactgatggcgcgagggaggcgatacg

SEQ ID NO: 792808 - DNA, 641 bp, Homo sapiens
  misc_feature: 58728.44.19.B08.1.pb.heavy.1.raw 58728
cgtatcgcctccctcgcgccatcagacagtatatacacgaccggtgctcgatttagtgagtcagtaaggggactcctgtgccccaccatggacacactttgctccacgctcctgctgctgaccatccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagcccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgcctgctccaggagcacctccgagagcacagcggccctgggctgcctggtcaaggactacttcctatatactgtctgagcggctggcaaggcgcatag

SEQ ID NO: 792809 - DNA, 694 bp, Homo sapiens
  misc_feature: 58729.44.55.E11.1.pb.heavy.1.raw 58729
ctatgcgccttgcagccgctcagacagtatataggaagtagtccttgaccaggcagcccagggccgctgtgcccccagaggtgctcttggaggaggggtgccagggggaagaccgatgggcccttggtgaggcggaggcgacggtgaccagggttccctggccccagaagtcaaacgaataataaccactccgagcgccgacttgtctcgcacagtaatgacggccgtgtcgtcgcctctcaggttgttcattgaagataaaccgtgttcctggaattgtccctggagatggtgaatcggcccttcacggagtcgcgtagtatgtgaaatcaccagtataatgaactgagacccactccagcccttcctggagccctggcggacccaactcatgtagttgctgctgacggtgagcccagaggctgcacaggagagtctctgggacccccaggctggactaagcctcctccagactccatcagccgcacctcacactggacaccttttaaagtccaacaaggagaacccagctcagccaaactccatggtggatctctgtgttcagtgctgatcaccgaatggaaacacctcggaatcccagtgctgggctcctctccccccaaacccaacgtgcgagtgctaatcgagcaccggtcgtgtatatactgtctgatggcgcgagggaggcgatacg

SEQ ID NO: 792810 - DNA, 663 bp, Homo sapiens
  misc_feature: 58755.44.12.B01.1.pb.heavy.1.raw 58755
cgtatcgcctccctcgcgccatcagacagtatatacacgaccggtgctcgatttagtagtgtagatcccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctcctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 792811 - DNA, 620 bp, Homo sapiens
  misc_feature: 58793.44.23.C01.1.pb.heavy.1.raw 58793
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgaggaggcgatacg

SEQ ID NO: 792812 - DNA, 561 bp, Homo sapiens
  misc_feature: 58836.44.78.H01.1.pb.heavy.1.raw 58836
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtgggccagggaaccctggtcaccgtctcctcagcctccaccaaggcgcccatcggtcttccccctggcgccctggctccaggagcacctccgagagcacagcgcccctgggctgcctggtcaaggactacttcctatatactgtctgagcgggctg

SEQ ID NO: 792813 - DNA, 643 bp, Homo sapiens
  misc_feature: 58838.44.23.C01.1.pb.heavy.1.raw 58838
cgtatcgcctcctcgcgccatcagacagtaatacacgaccggtgctcgatttagtacacgtgattagggattgggggctttctgagagtcaaggacctcctgtgcaagaacatgaagcactgtggtttttcctcctgctggtggcagctcccagatgggtcctgtcccaggtgcagctgcaggagtcggcccaggactggtgaggccttcggaaccctgtctctcatctgcactgtctctggagtttcatcagttctgatcattcttggggctggatccggcagccccccagggagggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggccatcggtcttcccctggcgccctgctccaggagcacctctggggcacagcggccctgggctgcctggtcaaggactacttcctatatactgtctgagcgggctggcaaggcgcatag

SEQ ID NO: 792814 - DNA, 707 bp, Homo sapiens
  misc_feature: 58854.44.56.F01.1.pb.heavy.1.raw 58854
ctatgcgccttgccagcccgctcagacagtaatttataggaagtagtccttgaccagcagcccagggccgctgtgcccccagaggtgctcctggagcagggcgccagggggaagaccgatgggcccttggtggaagctgaagagacggtgaccattgtcgcctgccccaaatatcaaatgcatcgacgtcccaggatcgcctggcgcagtaatagacgcctgtgtcgtcgggtctcaggttgctcatttgtaatggccaacactgttggagtcatcccttgagacggtgaatcttcccttcacagacgccggcgtactctttacttccaccataacgtttcattctgacgaagtgatccactcaagccccttcctggagcctgacggaccaggccaagtgataatcactaagactgaatcctgagactacacaggagagtctcagagacgccctggctgtgccaagcccccccgatccgcagtcgccctcgcactgacaccttctaaaaaaaactacaaggaaaatcaagattagcccaaactccatggttggtggtctgtgctcagtgctgatcaccaagtggaaactcctgggaatctcacggctgggggcccctctccagagctcccctttgtgtgtttcagacgtctgctaaatcgagcaccggtcgtgtatatactgtctgatggcgcgaggaggcgatacg

SEQ ID NO: 792815 - DNA, 706 bp, Homo sapiens
  misc_feature: 58856.44.62.F07.1.pb.heavy.1.raw 58856
ctatgcgccttgccagcccgctcagacagtatataggaagtagtccttgaccaggcagccagggccgctgtgctctcggaggtgctcctggagcagggcgccaggggaagaccgatgggcccttggtggaggctgaagagacggtcaccactgtcccccggcccaagtactaaaggtgtcatggggggtcaccgtggtcctggctttcaaacagtaatagacgcctgtgtcctcgggtctcaggttttcatttggagaaacaatttgtcctgcgaattgtccctggaaatggtgaagcggcccttcacggagtctccgtagaaagtgacaccaccagctccgatacttgagacccactccagtcccctccctggagccggcggacccaggtcatgccataggcactaaaggtgaatccagaggccgcacaggagagggtcagggacctcccaggccgaatcaggccccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctggctcctctctcagagctcccctttccctttatgcgactactaaatcgagcaccggtcgtgtatatactgtctgatggcgcgagggaggcgatacg

SEQ ID NO: 792816 - DNA, 707 bp, Homo sapiens
  misc_feature: 58867.44.36.D03.1.pb.heavy.1.raw 58867
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaggtgtccactgtgaggtgcggctggtggagtctggggaggctggtacagcgggggggtccctgagactctcctgtgcagcctctggattcatcttcagtgactatgccatgaactggtccgccaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactggggccgggggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792817 - DNA, 706 bp, Homo sapiens
  misc_feature: 58890.UNK.UNK.UNK.pb.heavy.1.raw 58890
cgtatcgcctccctcgcgccatcagacagtatatacacgacggtgctcgatttagagtatacatattgggtttggggggggagaggagcccagcactgggattccgaggtgtttccattcggtgatcagcactgaacacagaggaactcaccatggagttttggctgagctgggttctccttgttggactttttaaaaggtgtccagtgtgaggtgcggctgatggagtctggaggaggcttagtccagccctgggggtcccagagactctcctgtgcagcctctgggctcaccgtcagcagcaactacatgagttgggtccgccaggctccagggaaggggctggagtgggtctcagtcatttatactggtgatttcacatactacggcagactccgtgaaggggcgattcaccatctccagggacaattccaggaacaccggttatcttcaaatgaacaacctgagaggcgacgacacggccgtctattactgtgcgagacaagtcggcgctcggagtggttattattcgtttgacttctggggccagggaaccctggtcaccgtcgcctccgcctccacaagggccatcggtcttcccctggcaccctcctccaagagcactctgggggcacagcggccctgggctgcctggtcaaggactacttcctatatactgtctgaggcgggctggcaaggcgcatag

SEQ ID NO: 792818 - DNA, 705 bp, Homo sapiens
  misc_feature: 58914.44.36.D03.1.pb.heavy.1.raw 58914
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggggagacttggtccagcctggagggtccctgagactctcctgtgtcgcctctggattcaccatcagtgaccactatatggactgggtccgccaggctccagggaaggggctggagtggcttggccgcagtaaaaaacaaagttgccagctttatcacagagtacgccgcgtctgtgaaagccagattcaccctctcaagagatgacttcaagaaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 792819 - DNA, 724 bp, Homo sapiens
  misc_feature: 58964.44.39.D06.1.pb.heavy.1.raw 58964
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacggtgaccgacgtccccctgccccagacatccatcaaatagtagtagttttatgattccccgaaccgtttccttggaggtccccctcgcacagtaataaacagacgtgtcgtcaactctcacgctgttcatttgcaaatacagcatattcttggaattgtctctggagatggtgaatcggcccttcacgagtctgagtaatacttctcacttccatcgtcggagatgactgccacccactccggccccttgcctggagcctggcggacccagtgcaaaccaaatctatcgaatgagaaccagaggctacacaggagagtctcagggacctcccgggctggaccacgcctccccagactccaccaagtgctcctgacactggacacctcttaaaagagcaacgaggaaaacccagctcagcccaaactccatggtgagtcctctgtgttcagtgatgatcaccgaatggaaacaccggcgacttccagtgctggctcgtctctcccccaaagaactgcgagatgtcactaaatcgagcaccggtcgtgtatatactgtctgatggcgcgagggaggcgatacg

SEQ ID NO: 792820 - DNA, 690 bp, Homo sapiens
  misc_feature: 58968.UNK.UNK.UNK.pb.heavy.1.raw 58968
cgtatcgcctccctcgcgccatcagacagtatatacacgaccggttccgatttagctgcgtcacgatctctcttggagctggagagcggagcccagcccagattccaggtgtttcattggtgatcagcactgaacacagaggactcaccatggagtttcgggctgagctgggttttccttgttgttattttacaaggtgtccagagtgaagtgcagttggtggagtccgggggagactggtccagcctggagggtcctgagactctcctgtgtcgcctctggattcaccatcagtgaccactatatggactgggtccgccaggctccagggaggggctggagtggcttggccgcagtaaaaacaaagttgccagcttatcacagagtacgccgcgtctgtgaaagccagattcaccctctcaagagatgacttcaagaactcattgattctgcgaatgactaacctgaaaaccgaggacacgggcatgtattattgtgtgtgtttatatcaggaactgttccactggggccaggaaccctggtcaccgtctcctcagcctccaccaaagggccatcggtcttccccctggcgccctgcccagagcacctccgagagcacagcggccctgggctgcctggtcaaggactacttcctatattactgtctgagcgggctgcaagggggcatag

SEQ ID NO: 792821 - DNA, 702 bp, Homo sapiens
  misc_feature: 58980.44.67.G01.1.pb.heavy.1.raw 58980
cgtatcgcctccctcgcgccatcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaaggcccatcggtcttcccctggcaccctcctccaagagcacctctgggggcacagcggccctggctgcctggtcaaggactacttcctatatactgtctgagcgggctggcaaggcgcatag

SEQ ID NO: 792822 - DNA, 696 bp, Homo sapiens
  misc_feature: 58990.UNK.UNK.UNK.pb.heavy.1.raw 58990
ctatgcgccttgccagcccgctcagacagtatataggaagtagtccttgaccaggcagccagggccgctgtgctctcgaggtgctcctggagcaggtgcgcagggaagaccgatggggcccttggtggaggctgaggagacggtgaccagggttccctggcccagtggacagttcctgatataaacacaacaccaataatacatgcccgtgtcctcgtttttcaggttagtcattcgcagaatcaatgagttcttgaagtcatctcttggagggtgaatctggcttcacagacgcggcggtactctgtgataaagctggcaacttgtttttactgcgccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacaacaaggaaaaccagctcagcccgaactccatggtgagtcctctgtgtcagtgctgatcacaatgaaaacacctggaattctggggctgggcctcccgctctcagagctccgccaagagagatcgtgacgcagctaaatcgagcacccggtcgtgtatatactgtctgatggccgcgaggaggcgatacg

SEQ ID NO: 792823 - DNA, 644 bp, Homo sapiens
  misc_feature: 59005.44.86.H09.1.pb.heavy.1.raw 59005
ctatgcgcctgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcgcggtcacggaggtcagtttcagggagaagcggttcatggacgtgtccctcgaaatggtgagacgactcttgagggacggagagtagtacgtcgccccagtataatggatgtcaccaatccactcattcccctccctggggctgcggatccagccccaagaatgatcagaactgatggaaactccagagacagtgcagatgagagacagggttcccgaaggcctcaccagtcctggcccgactcctgcagctgcacctggacaggacccatctgggagctgccaccagcaggagaaaaaccacaggtgcttcatgtcttgcacagaggtccttgactctcagaaagcatccccaaacccaagtctatagcactaaatcgagcaccggtcgtgtatatactgtctgatggcgcgagggaggcgatacg

SEQ ID NO: 792824 - DNA, 685 bp, Homo sapiens
  misc_feature: 59012.UNK.UNK.UNK.pb.heavy.1.raw 59012
ctatgcgccttgccagcccgctcagacagtatataggaagtagtccttgaccaggcagcccaggccgctgtgctctcgaggtgctcctggagcagggcgccagggggaagaccgatgggcccttggtggaggccgagagacggtgaccagggttccctggccccaggcgtcgaatgaaccgattttggaaacagatagtctcgcacaaaaatacacgccgtgtcctgaggtctcaggctgttcatttgaagagacactgtgtttctcggaattgtctctggagatggtgaatcggccctcacggaatcaccgtagacttgatttcctccatgaatgacacacctgccaccactccagccctcgcctggagcctggcggacccactgcatatccattatcgaaggtgaaatccagaggctgcacaggagagtctcagggaccccctactgggccacgcctcccccagactccacgaattgcacctgacacatgacacctctaagagggcaacgagggaaacccagctcagcccaaactccatggtgagtcctctgtgttcagtgatgatcaccgagtggaacaccggcgacttcagtgctggctcgtctcccagcccaaaccttcgatcgcgtctaaatcgagcaccgtcgtgttatactgtctgatggcgcgaggaggcgatacg

SEQ ID NO: 792825 - DNA, 689 bp, Homo sapiens
  misc_feature: 59019.44.45.E01.1.pb.heavy.1.raw 59019
cgtatcgcctccctcgcgcgccatcagacagtatatacacgaccggtgctcgatttagtgagtcagtaagggaaagggctgggagaggagcccagcactagaagtcggcggtgtttccattcggtgatcagcactgaacacagagactcaccatggagtttgggctgagctgggttttcctcgttgctcttttaagaggtgtccagtgttcaggttcagctggtggagtctgggggaggcgtggtcagcctggcacgtcctgaagactctcctgtgttgcgtccggactcagtttcagtgactctgcatgcactgggtccgcaggctccaggcaaggggctggagtgggtggcagtcatctggtctgatgcgaagtaaagaatactatgggaaactccgtgaagggcgatctccggttcccagagacaattccaagaacaccgtgtatctacacaatgaacaatttgagagccgaggactcggctctctattattgtacgagcccatcgtttctacctggggccgagggagggcctggtcaccgtctcctcagcctcaccaagggcccatcggtcttccctggcgcccctgctgccagggagcacctccggagcacagcggccccctgggctgcctggtcaaggactacttcctatataggtctgagcgggctggcaaggcgcataggg

SEQ ID NO: 792826 - DNA, 681 bp, Homo sapiens
  misc_feature: 59023.44.9.A09.1.pb.heavy.1.raw 59023
ctatgcgccttgccagcccgctcagacagtatataggaagtagtccttgaccaggcagcccagggccgctgtgctctcggaggtgctcctgagcagggcgccaggggaagaccgatgggcccttggtggaggctgaggagacggtgaccagggttccctggccccagtagtcaagcggggacgtctcgagggggctctcgcacaataatagacagccgtgtcctcacttgtgaggttgtacatttgcagatgcagtgtgttcctggaattgtctctggagacggtgaatcggccttctcggagtctccgtagtgttcttcaattccatcttctgatataattgccaccactccagccccttgcctggagcctggcggaccagtgcatggcataggtcctgaagatgaatccagaggctgcacaggagagtctcaggagttccaggctgggcgctcctccccagactccactagctgcacctgacactggccacctcttaaaagagcaacgaggaaaacccatctcagcccaaagtccatggtgagtcctctgtgttcagtgatgatcacgaatggaaacaccggcgacttccagtgctgggctcgtctcccccctgcgcgtctcgctaaatcgagcaccggtcgtgtatatactgtctggtggcgcgagggaggcgatacg

SEQ ID NO: 792827 - DNA, 606 bp, Homo sapiens
  misc_feature: 59037.UNK.UNK.UNK.pb.heavy.1.raw 59037
gaaggctgggcaggctatgcaccctggtccaggtcaaaagctgcggaacccgctagcggccatcttggccactaggggtcccgcagattcatattgtcgtctagcatgcacaatgctgcaacccagcttgcaatgcccacagcaagcggccaatctttacgccacgttgaattggtttattacctgtgactggctatggcttgcaacgccactcgtaaaactagtactttgcggttaggggaagtagacaaacccattactccacttcccggaagttcaactcattccaacacgaaataaaagtaaactcacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatccagaccgcatctggcgcctaaacgttcagtggtagctaaggcgtcaccttcgactgtctaaaggcaatattgtcgtccttagctccaagtccctagcaagcgtgtcggg

SEQ ID NO: 792828 - DNA, 718 bp, Homo sapiens
  misc_feature: 59072.UNK.UNK.UNK.pb.heavy.1.raw 59072
cgtatcgcctcctcgccgccatcagacagtatatacacgaccggtggctcgatttagtagtcgccataaagggaaaggggagctctggagagaggagcccagccctgggattttcaggtgtcttcatttggtgaccgaggacgaacagagagaagtctccatggagtttgggctgagctgcctttttcttgtggcttttttaaggggtgtcgtgtgtgaagtgcagttgttggagtctgggggggcctgattcggcctgcggaggtccctgaccctctcctgtgcggcctctggattcacctttagtgcctatggcatgacctgggtccgccgggctcccaggaggggactggagtgggtctcaagtatcggagctggtggtgtcactttctacgggagactccgtgaagggccgcttcaccatttccagggacaattcgcaggacaaattgtttctccaaatgaaaaacctgaagacccggaggacacaggcgtctattactgtttgaaagccaggaccacggtgaccccccatgacacctttagtacttggggccggggacagtggtgaccgtctcttcagcctcccaccaaggggcccatcggtcttcctggcgcctgctccaggagcacctccgagagcccagcggccctgggctgcctggtcacaggactacttcctataatactgtctgagcgggtctggcaaggcgcatag

SEQ ID NO: 792829 - DNA, 677 bp, Homo sapiens
  misc_feature: 59074.UNK.UNK.UNK.pb.heavy.1.raw 59074
ctatgcgccttgccagccgctcagacagtatataggaagtagtccttgaccaggcagcccagggccgctgtgcccccagaggtgctcttggaggaggggggtgccagggggaaagaccgatggggcccttggtggaggctgaggagacggtgaccagggttcccctggccccagtggtcaaagagttcgcggttgacgaactcggcctactctcgcacataatacacggccgtgtcgcggcggtcacagagctcagcttcagggagagaactggttcttgagacgtgtctactgactatcggtgactcgactcttgaggacgggttgtagtaggtgctgcccactataatagatacctccaatccactccagcccttccctggggctggcggatccaacccagtagtaactactactgctgatggagccaccagagacagtgcaggtgagggacagggtctccgaaggcttcaccagtcctgggcccgactcctggcagctgcagctgggacaggacccatcctggagccgccaccagcaggaggaagaaccacaggtgcttcatgttcttgcacaggaggtccatgactctcagaaagccccccgcggaatctacactactaaatcgagccaccggtcgtgtatatactgtctgatggcgcgagggaggcgatacg

SEQ ID NO: 792830 - DNA, 701 bp, Homo sapiens
  misc_feature: 59082.44.74.G08.1.pb.heavy.1.raw 59082
ctatgcgccttgccagcccgctcagacagtatataggaagtagtccttgaccaggcagccccagggccgctgtgcccccagaggttgctcctggagcaggcgccaggggaagaccgatgggcccttggtggaagctgaggtgacaatgaccagggttccctgcccccagatctcaaaggctccatgcgagctggtggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccccaaaaagaggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggaactggacacctgttgctgctgccaccacaaagaggaacctccagggtccagtccatggtgatgagctgtgctcccaggggcttctttagaggaggaatgtggttgttatgtgatgctccccctgatagagctactaaatcgagcaccggtcgtgtatatactgtctgatgggccgcgagggagggcgatacg

SEQ ID NO: 792831 - DNA, 712 bp, Homo sapiens
  misc_feature: 59114.44.27.C05.1.pb.heavy.1.raw 59114
ctatgcgccttgccagcccgctcagacagtatataggaagtagtccttgaccaggcagccccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcccccatgaaatgacacacctgccacccactccagcccctcgcctggagcctggcggacccactgcatattccaattatcgaaggtgaatccagaggctgcacaggagagtctcagggaccccccctactggggccacgcctcccccagactccacgaattgcacctgacacatgacacctcttaagagggcaacgaggaaaaacccagctcagccccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 792832 - DNA, 700 bp, Homo sapiens
  misc_feature: 59136.UNK.UNK.UNK.pb.heavy.1.raw 59136
cgtatcgcctccctcgcgccatcagacagtatatacacgacgtgcctcgatttagctgcgtcacgatctctcttggggagctctgagagcggagccccagccccagaattcccaggtgttttcatttggtgatcagcactgaacacagaggactcaccatggagttcggctgagctgggttttccttgttgttattttacaaggtgtccagagtgaagtgcagttggtggagtccgggggagacttggtccagctggagggtcctgagactctcctgtgtcgcctctggattcaccatcagtgaccactatatggactgggtccgccaggctccagggaaggggctggagtggcttggccgcagtaaaaaacaaagttgccagctttatcacagagtacgccgcgtctgtgaaagccagattcaccctctcaagagatgacttcaagaactcattgattctgcgaatgactaacctgaaaaaccgaggacacgggcatgtattattgtgttgtgtttatatcaggaactgtcactggggccagggaaccctggtcaccgtctcctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 792833 - DNA, 689 bp, Homo sapiens
  misc_feature: 59140.UNK.UNK.UNK.pb.heavy.1.raw 59140
ctatgcgccttgccagccccgctcagacagtatataggaagtagtcttgaccaggcagcccaggccgctgtgccccagaggtgctcctggagcagggcgccagggggaagaccgatggcccttggtggaagctgaagagacggtgaccattgtcccctgcccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccatacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaaactacaaggaaaatcaagattagcccaaactccatggttggtgtctgtgctcagtgctgatcaccaagtggaaactcctgggaatctcacggctggggctcctctctcttgcgacgacactaaatcgagcaccggtcggttatatactgtctgatggcgcgaggaggcgatacg

SEQ ID NO: 792834 - DNA, 651 bp, Homo sapiens
  misc_feature: 59149.44.23.C01.1.pb.heavy.1.raw 59149
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 792835 - DNA, 682 bp, Homo sapiens
  misc_feature: 59191.44.45.E01.1.pb.heavy.1.raw 59191
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaaactccgtgaagggccgattctccgtctccagagacaattccaagaacaccgtgtatctacaaatgaacaatttgagagccgaggactcggctctctattattgtacgagcccatcgttctactgggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792836 - DNA, 720 bp, Homo sapiens
  misc_feature: 59192.UNK.UNK.UNK.pb.heavy.1.raw 59192
ctattgcgccttgccagccgctcagacagtatataggaaagtagtccttgaccaggcagcccagggccgctgtgcccccagaggtgctcttggaggagggtgccaggggaagacgatggcccttgtggaggctgaggagacggcgaccgtggtcccttggccccaggcgtccataccattggagtagagcatgtcatatctgtatcacgagccccatctctcgcacagtagtagacagccgtgtctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgtgaaggtggaatccagacgctacacaggagagtctcagggacctcccaggctggaccacgcctcccccagactccaccagcttcacctgacactggacacctcttaaaagagcaacgaggaaaacccaggtcagcccaaactccatgtgagtcctctgtgttcggtgctgatcacgactggaaacacgccgacttctggtgctgggctcctcccagagctcccaaacccaacgagctcactctaaatcgagcaccgggtcgtgtatatactgtctgatggcgcgagggaggcgatacg

SEQ ID NO: 792837 - DNA, 693 bp, Homo sapiens
  misc_feature: 59210.44.67.G01.1.pb.heavy.1.raw 59210
ctatgcgccttgccagccgctcagacagtatataggaagtagtccttgaccaggcagcccagggccgctgtgcccccagaggtgctcttggaggagggtgccaggggaagacgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatgggaatcggcccttcacgagtctgcgtagtatgtgaaatcacagtataaatgactgagacccactccagcccttccctggagcctggcggacccaactcatgtagttgctgctgacggtgagccagaggctgcacaggagagtctctgggacccccaggctggactaagcctcctccagactccatcagccgcacctcacactggacaccttttaaaagtccaacaggagaacccagctcagccaaaaactccatggtgagtctctgtgtcagtgctgatcaccgaatggaaacacctcggaatcccagtgctggctcctctcccccccaaacccaatatgtatactctaaatcgagcaccggtcgtgtatatactgtctgatggcgcgaggaggcgatacg

SEQ ID NO: 792838 - DNA, 695 bp, Homo sapiens
  misc_feature: 59226.UNK.UNK.UNK.pb.heavy.1.raw 59226
cgtatcgcctcctcgcgccatcagacagtatatagacgacggtgctcgatttagcactcgcacgttgggtttggggagaggagcccagcactgggatccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacgtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcggtcttccctggcaccctcctccaagagcacctctggggcacagcggccctgggctgcctggtcaaggactacttcctatatactgtctgagcgggctggcaaggcgcatag

SEQ ID NO: 792839 - DNA, 700 bp, Homo sapiens
  misc_feature: 59255.44.55.E11.1.pb.heavy.1.raw 59255
ctatgcgccttgccagcccgctcagacagtatataggaagtagtccttgaccaggcagcccagggccgctgtgccccagaggtgctcttggaggagggtgccaggggaagaccgatgggccttggtggaggcggaggcgacggtgaccagggttccctggccagaagtcaaacgaataataaccactccgagcgccgacttgtctcgcacagtaatagacggccgtgtcgtcgcctctcaggttgttcatttgaagataaccgtgttcctggaattgtccctggagatggtgaatcggcccttcacggagtctgcgtagtatgtgaaatcaccagtataaatgactgagacccactccagccccttccctggagcctggcggaccccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcacgaatggaaacacctcgaatccagtgctgggctcctctcccccccaaaccccaacgtgcgagtgctaaatcgagcaccggtcgtgtatatactgtctgatggcgccgagggaggcgatacg

SEQ ID NO: 792840 - DNA, 695 bp, Homo sapiens
  misc_feature: 59277.UNK.UNK.UNK.pb.heavy.1.raw 59277
ctatgcgccttgccagcccgctcagacagtatatagggaagtagtcttgaccaggccagcccaggccgctgtgcccccagaggtgccttggaggagggtgccaggggaagaccgatgggccttggtggaggcggaggcgacggtgaccagggttccctggccccagaagtcaaacgataataaccactccgagcgccgacttgtctcgccacagtaatagacggccgtgtcgtcgcctctcaggttgttcatttgaagataaaccgtgttcctgaattgtccctggagatggtgatcggccttcacggagtctgcgtagtatgtgaaatcaccagtataaatgactgagacccactccagcccttccctggagcctggcggacccaacccatgtagttgctgctgacggtggagccccagaggctgcacagagagtctctggacccccaggctgactaggcctcctccagactccatcagccgcacctcacactggacacctttaaaagtccaacaaggagaacccagcctcagccaaaactccatggtgagtcctctgtgttcagtgctgatcaccgaatggaaacacctcggaatcccagtgctgggctcctctccccaaccccaacgtgcgagtgctaaatcgagcaccggtcgggtatatactggtctgatggcgcgagggaggcgatacg

SEQ ID NO: 792841 - DNA, 623 bp, Homo sapiens
  misc_feature: 59278.UNK.UNK.UNK.pb.heavy.1.raw 59278
ctatgcgccttgccgccgcgctcagacagtatataggagtagtccttgaccggcagcccaggccgctgtgctctcggaggtgctcctggagcaggcccaggggaagacgatggcccttggtgagctgatgagacggtgacctggattcctgccccagggttcgaagaagcccgtggtcattgtggtcatgaagtggcacagaaatatgtgcctgtgtcacaggcgttcacgttggtcatgtaaggaccacctggttttgacgtgccgtgacgcggagtctggtcgcagagaaggactatatcggatatcgtcattccaataagtgagtgcgacgaccactcagggctttccgggggcgcacccagacaacgcctcggtctccaggtacagtgagaccaagtggacctgtggcacggcagaactctgtgtggccaccttcatgaccggcaactgacccacggtgtcttcgaaccctgggcagaatccaggtcaccgttcagcagcctccacccaagccatcgtcttccatggcgcctgctccaggcagtccgacaccacttactggctcctggtccaaggacacgtcgtgtatatactgtctgatggcgcgagggaggcgatag

SEQ ID NO: 792842 - DNA, 710 bp, Homo sapiens
  misc_feature: 59301.44.36.D03.1.pb.heavy.1.raw 59301
ctatgcgccttgccagcccgctcagacagtatataggaagtaagtccttgaccaggcagcccagggccgctgtgctctcggaggtgctccttggagcaggcgccagggggaagaccgatgggccccttggtggaggctgaggaggacggtgaccagggttccctggccccagtggacagttcctgatataaaccacaacacaataatacatgcccgtgtcctcggttttcaggttagtcattcgcagaatcaatgagttctttgaagtcatctcttgagagggtgaatctggctttcacagacgcggcgtactctgtgataaagctggcaactttgttttactgcggccaagccactccagccccttccctggagcctggcggaacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatgtgagtcctctgtgttcagtgctgatcaccaaatgaaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 792843 - DNA, 704 bp, Homo sapiens
  misc_feature: 59302.44.36.D03.1.pb.heavy.1.raw 59302
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792844 - DNA, 692 bp, Homo sapiens
  misc_feature: 59314.44.74.G08.1.pb.heavy.1.raw 59314
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctggggcacagcggccctggctgcctggtcaaggactacttcctatatactgtctgagcgggctggcaaggcgcatag

SEQ ID NO: 792845 - DNA, 702 bp, Homo sapiens
  misc_feature: 59338.UNK.UNK.UNK.pb.heavy.1.raw 59338
ctatgcgccttgccagcccgctcagacagtatataggaagtagtccttgactaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacgtgagcccagaggctgcacaggagagtctctgggaccccccaggctggactagcctcctccagactccatcagccgcacctcacactggacacctttaaaagtccaacaaggagaacccagctcagccaaaaactccatggtgagtcctctgtgtcagtgctgatcaccgaatggaaacacctcggaatcccagtgctggctcctctccccccccaaacccaacgtgcgagtgctaaatcgagcacggtcgtgtatatactgtctgatggcgcgagggaggcgatacg

SEQ ID NO: 792846 - DNA, 615 bp, Homo sapiens
  misc_feature: 59347.UNK.UNK.UNK.pb.heavy.1.raw 59347
cccgacacgcttgctagggacttggagctaaggacgacatattgcctttagacagcggtcgaaggtgacgccttagctaccactgaacgtttaggcgccagatgcggtctgggatgacctaactcgcagcttatcgatgatctactgcacgctcaaaccaaccaggtcttgatgcgcgcgataggactgacgggatcgctacagacatttaactcgctaagtaacttaattgagatcctaggggatgggataggaaatagaatccacccctatcacccccccacatagcctgcttggggtgttgagtttacttttatttcgtgttggaatgagttgaacttccgggaagtgggagtaatgggtttgtctacttccctaaccgcaaagtactagttttacgagtggcgttgcaagccatagccagtcacaggtaataaacaattcaagcgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgccccagccttc

SEQ ID NO: 792847 - DNA, 685 bp, Homo sapiens
  misc_feature: 59391.UNK.UNK.UNK.pb.heavy.1.raw 59391
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccaggttccctggccccaggggtcgagcagttcgcccccccgtctctactgtatcgataggaatctctcgcacaataatatacggccgtgtcgcggcggtcacagaagtcaatttcagggagaaactggttcttggacctgtctagtgacatggtgactcgactcttgagggcggggtttgtagttggtgctgccactgttatagatgcgcccaatccactccagtcccttcccggcggactgcccgcagccaactccaataataactactgatggtaaccaccagagacattgcaggtgaggggacagggtctccgaaggcttcacccgtcctggggccgactcctgcagctgcacctcggacacgacccatctgggaggtgccaccaggaggaggaagaaccacaggtgttttcatgttcttgtgcaggaggcccatgagtctcagaaagtatcccccaaaacccaactatcgtgtgctaaatcgagccaccggtcgtgtatatactgtctgatggcgcgagggaggcgatacg

SEQ ID NO: 792848 - DNA, 703 bp, Homo sapiens
  misc_feature: 59397.44.36.D03.1.pb.heavy.1.raw 59397
ctatgcgccttgccagcccgctcagacagtatataggaagtagtccttgaccaggcagcccaggccgctgtgctctcggaggtgctgcctggagcagggcgccagggggaagaccgatgggcccttggtggaggctgaggagacggtgaccagggttccctgggcccagtgacagtttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaacttgtttttactgcggccaagccactccagccccttccctggagcctggcggacccagtccatatagtggtcactgatggtgaatccagaggcgacacaggaggtctcaggaccctccagggtggaccaagtctcccccggactccaccaactgcacttcactcgtggacaccttgtaaataaataacaacaaggaaaacccagctcagccgaactccatggtgagtcctctgtgttcagtgctgatcaccaaaatgaaaacacctgggattctggggctgggctcgctctcagagctccccaagagagatcgtgacgcagctaaatcgagcaccggtcgtgtatatactgtctgatggcgcgagggaggcgatacg

SEQ ID NO: 792849 - DNA, 707 bp, Homo sapiens
  misc_feature: 59401.44.27.C05.1.pb.heavy.1.raw 59401
cgtatcgcctccctcgcgccatcagacagtatatacacgaccggtgctcgattttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgttggccccagtaggggggtccctgagactctcctgtgcagcctctggattcaccttcgataattggaatatgcagtgggtccgccaggctccaggcgagggctggagtggggtggcaggtgtgtcatttcatggaggaaatcagtctacggtgattccgttgagggccgattcaccatctccagagacaattccgagaaacagtgtctcttcaaatgaacagcctgagacctcaggacacggccgtgtatttttgtgcgagactatctgtttccaaaatcgttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792850 - DNA, 686 bp, Homo sapiens
  misc_feature: 59431.UNK.UNK.UNK.pb.heavy.1.raw 59431
ctatgcgccttgccagcccgctcagacagtatataggaagtagtccttgaccaggcagcccaggggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctgagcctggcggacccagtgcatggcagagtcactgaaactgagtccggacgcaacacaggagagtctcagggacgtccaggctggaccacgcctccccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctcctccccagccccttttccccttactgactcactaaatcgagcacggtcgtgtatatactgtctgatggcgcgagggaggcgatacg

SEQ ID NO: 792851 - DNA, 682 bp, Homo sapiens
  misc_feature: 59439.UNK.UNK.UNK.pb.heavy.1.raw 59439
ctattgcgccttgccagcccgctcagacagtatataggaagtagtccttgaccaggcagcccagggccgctgtgctctcggaggtgctcctggagcaggcgccagggggaagaccgatgggcccttggtggaggctgaggagacggtgaccagggctccctggccccagtagaacgatgggctcgtacaataatagagagagccgagtcctcggctctcaaattgttcatttgtagatacacggtgttcttggaattgtctctggagacggagaatcggccccttcacggagtttccatagtattctttacttccatcagaccagatgactgccaacccactccaggcccctttgcctggagcctggcggacccagtgcatggccagagtcactgaacgagtccggacgcaaccaggagagtctcaggacgtcccaggctggaccacgcctccccagactccaccagctgaacctgacactggacacctcttaaagagcaacgaggaaacccagctcagcccaaactccatggtgagtcctctgtgttcagtgctgatcaccgaatggaaacaccgccgacttctagtgctgggctcctctcccgcccctttccttaactgactcactaaatcgagcaccggtcgtgtatatactgtctgatggcgcgagggaggcgatacg

SEQ ID NO: 792852 - DNA, 646 bp, Homo sapiens
  misc_feature: 59452.44.53.E09.1.pb.heavy.1.raw 59452
cgtatcgcctccctcgcgccatcagacagtatatacacgaccggtgctcgatttagagagagtgtgttgggtttggggaagcacctgtggttcttcctcctgctggtggcggctccagatgggtcctgtctcagccgcagctgcgggagtcgggcccaggactggtgaagccttcggagaccctgtcctcacgtgcacggtctctggtgcctccatcgacagaagtaatttctactggggctgggatccgccagccccaggagaggggctgcagtggattggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttggacgtctgggccaagggaccacggtcaccgtctcctcatcctcagcctccaccaaggcccatcggtcttcccctggcgccctgctccaggagcacctccgagagcacagcggcctgggctgcctggtcaaggactacttcctatatactgtctgagcgggctggcaaggcgcatag

SEQ ID NO: 792853 - DNA, 584 bp, Homo sapiens
  misc_feature: 59453.UNK.UNK.UNK.pb.heavy.1.raw 59453
cgtatcgcctccctcgcgccatcagacagtatatacacgaccgtgctcgatttagtgtgagtagtttgggtttggggggaagagaagactgacggtccactccaggtacagctggtgcagtctggggctgaggtgaagaagcctggggcctcagtgacagtctcctgcacggcttctggatacacgttcatcaattatgatattaactgggtgcgacaggccgctggacaagggctggagtggatggatggatgaaagccctatagtggcaacacggctttgcccagaagttccaaggcagagttagtatgaccaggagcactccccaggtacagtctacatggaactgagcagcctgagatctgaggacacggccgtgtatttctgtgcgagagcaccagcacctggctttgattgtggggccagggaacccgggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 792854 - DNA, 693 bp, Homo sapiens
  misc_feature: 59493.44.36.D03.1.pb.heavy.1.raw 59493
cgtatcgcctcctcgcgcatcagacagtatatacacgaccggtgctcgatttagctgcgtcacgatctctcttggggagctctgagagcggagcccccagcccagaattcccaggtgttttcatttggtgatcagcactgaacacagagactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgccgcgtctgtgaagccagattcaccctctcaagagatgacttcaagaactcattgattctgcgaatgactaactgaaaaccgaggacacggcatgtattattgtgttgtgtttatatcaggaactgtccactggggccagggaccctggtcaccgtctcctcagcctccaccaaggcccatcggtcttcccctggcgccctgctccaggagcacctcgagagcacagcggccctgggctgcctggtcaaggactacttcctatatactgtctgagcgggctggcaaggcgcatag

SEQ ID NO: 792855 - DNA, 714 bp, Homo sapiens
  misc_feature: 59494.UNK.UNK.UNK.pb.heavy.1.raw 59494
cgtatcgcctccctcgcgccatcagacagtatatacaccgaccggtgctcgatttagtatcactcagtcgcggggagctctgggagaggagcccagcactagaagtcggcggtgtttccattcggtgatcagcactgaacacagaggactcaccatggagttgggctgagctgggtttcctcgttgctcttttaagaggtgtccagtgtcaggtgcagctggtgagtctggggaggcgtgtccagcctggaggtcctgagactctcctgtgcagcgtcggattcaccttccagtacctatggcatgcactggtccgcaggctcaggcaaggggctggagtggtggccaacttatatggtatgatggaagtaataaatactatgcagactccgtgaagggccgattcaccatctccaggagacaattccgaagaacacgctgtatctgcaaatgaacaggcctgagagccgagacacggctgtgtattactgtgcgaggacatattgtagtactaccacctgctgggactactactacggtatggacgtctgggccaagaccacggtcaccgtctcctcagcctccaccaaagggccatcggtcttccccctggcaccctcctccaagagcactctgggggcacagcggccctgggctgcctggtcaaggactacttcctatatactgtctgagcgggctggcaagcgcgcatag

SEQ ID NO: 792856 - DNA, 712 bp, Homo sapiens
  misc_feature: 59505.UNK.UNK.UNK.pb.heavy.1.raw 59505
cgtaatcggcctcccctcgcgccatcagaacagtatatacacgaccgcggtgctcgatttagcactcgcacgttgggtttgggagaggagcccagcactgggattccgaggtgtttccattcggtgatcagcactgaacacagagacactcaccatggagttttggctgagctggttcctccttgttggacttttaaaaaggtgtccagtgtgaggtgcggctgatggagtctggaggaggcttagtccagcctggggtggtccgcagagactcctcctgtgcagcctcctggctcaccgtcagcagcaactacatgagttgggtccgccaggctccaggaaggggctgagtggggtctcagtcatttatactggtgatttcacataacgcagactcccgtgaagggccgattccaccatctccagggacaattcaggaacaccggtttatcttcaaatgaacaacctgagaggcgacgacacggccgtctattactgtgcgagacaagtcggcgctcggagtggttattattcgtttgacttctggggccagggaaccctggtcaccgtcgccctccgcctccaccaagggccatcggttcttcccctggcaccctcctccaagagcacctctgggggcacagcggccctgggctgcctggtcaaggactacttcctatatactgtctgagcgggctggcaaggcgcatag

SEQ ID NO: 792857 - DNA, 695 bp, Homo sapiens
  misc_feature: 59506.44.36.D03.1.pb.heavy.1.raw 59506
ctatgcgccttgccagcccgctcagacagtatataggaagtagtccttgaccaggcagcccagggccgctgtgctctcggagtgctcctggagcaggcgccaggggaagaccgatggcccttggtggaggctgaggagacggtgaccagggttccctggccccagtggacagttcctgatataaacacaacacaataatacatgcccgtgtcctcggttttcagggttagtcattcgcagaatcaatgagttcttgaagtcatctcttgagagggtgaatctggctttcacagacgcggcgtactctgtgataagctggcaactttgtttttactgcggcaagccactccagcccttccctggagcctggcggaccccagtccatatagtggtcactgatggtgaatccagaggcgacacaggagagtctcaggacctccaggctggaccaagtctcccccggactccaccaactgcacttcactctggacaccttgtaaaaaacaacaaggaaaaccagctcagcccgaactccatggtgagtcctctgtgttcagtgctgatcaccaaatgaaaacacctgggaattctggggctgggctccgctctcagagctccccaagagagatcgtgacgcagctaaatcgagcaccggtcgtgtatatactgtctgatggcgcgagggaggcgatacg

SEQ ID NO: 792858 - DNA, 562 bp, Homo sapiens
  misc_feature: 59574.UNK.UNK.UNK.pb.heavy.1.raw 59574
cagacagtatataggaagtagtccttgaccaggcagcccagggccgctgtgctccgaggtgctcctggagcagggcgccagggggaagaccggatgggcccttggtggaggctgaggagacggtgaccagggttccctggccccacaagtcagccaggtgctggtggctctcgcacagaaaacacggccgtgtcctcagatctcaggctgctcagttccatgtagactgtacctggggaggtgctcctggtcatactaactctgcttggaacttctgggcaaagcccgtgttgccactatagggcttcatccatcccatccactccagcccttgtccagcggcctgtcgcacccagttaatatcaaattgatgaacgtgtatccagaagccgtgcaggagactgtcactgaggccccaggctcttcacctcagccccagactgcaccagctgtacctgggagtgggaccgtcagtcttcctcttcccccaaacccaaacactcacactaaatcgagcaccggtcgtgtatatactgtctgatggcgcgagggaggcgatacg

SEQ ID NO: 792859 - DNA, 690 bp, Homo sapiens
  misc_feature: 59576.44.73.G07.1.pb.heavy.1.raw 59576
ctatgcgccttgccagcccgctcagacagtatataggaagtagtccttgaccaggcagcccagggcccgctgtgctctcggaggtgctcctggagcagggcgccagggggaagaccgatgggccctggtggagctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggcccttctcggagtctccgtagtgttcttcaaattccatcttctgatataattgccacccactccagccccttgcctggagcctggcgggacccagtgcatggcatagtcctgaagatgaatccagaggctgcacaggagagtctccagggagttcccaggctgggccgctcctccccagacttcactaggctgcacctgacactggccacctcttaaaagagcaacgaggaaaacccatctcagccaaagtccatggtgagtcctctgtgttcagtgatgatcaccgaatggaaacaccggcgacttcagtgctgggctcgtctcccccctgagcgtagagctaaatcgagcaccggtcgtgtatatactgtctgatggcgcgagggaggcgatacg

SEQ ID NO: 792860 - DNA, 645 bp, Homo sapiens
  misc_feature: 59602.UNK.UNK.UNK.pb.heavy.1.raw 59602
cgtatcgcctccctcgcgccatcagacagtatatacacgaccggtgctcgatttagtgctcatagacttgggtttggggatgctttctgagagtcaaggacctcctgtgcaagaacatgaagcacctgtggtttttctcctgctggtggcagctcacagatgggtcctgtccaggtgcagctgcaggagtcggggcccagactggtgaggcctttcgggaaccctgtctctcatctgcactgtcctggagtttccatcagttctgatcattcttggggctggatcggcagcccccagggaggggaatgagtggattggtgacatccattatactggggcgacgtactactctccgtccctcaaagtcgtctcaccatttcgagggacacgtccatgaaccgctttccctgaaactgacctccgtgaccgccgcggacacggccgttattctgtgcgaggcaagactggtctttcaatctatggggccgtggcaccctggtcactgtctccctcagcttccaccaagggccatcgtcttccccctggcgccctgctccaggagcacctctgggggcacagcggcccggctgcctggtcaaggactacttcctatatactgtctgagcgggctggcaaggcgcatag

SEQ ID NO: 792861 - DNA, 720 bp, Homo sapiens
  misc_feature: 59604.UNK.UNK.UNK.pb.heavy.1.raw 59604
cgtatcgcctccctcgcgccatcagacagtatatacacgaaccggtgctcgatttagtgctatagacttgggttgggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggcctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctggactgcctggtcaaggactacttcctatatactgtctgagcgggctggc

SEQ ID NO: 792862 - DNA, 702 bp, Homo sapiens
  misc_feature: 59614.44.55.E11.1.pb.heavy.1.raw 59614
ctatgcgccttgccagccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcggagggaggcgatacg

SEQ ID NO: 792863 - DNA, 679 bp, Homo sapiens
  misc_feature: 59616.UNK.UNK.UNK.pb.heavy.1.raw 59616
cgtatcgcctccctcgcgccatcagacagtatatacacgacggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattccggaacactctgtacctggaaatgatcagcctgagaggcgaggactcggctctgtattactgtgcgagatcggaagtggcagcagctattatcgggcgtttcactggggccagggacactggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 792864 - DNA, 695 bp, Homo sapiens
  misc_feature: 59617.UNK.UNK.UNK.pb.heavy.1.raw 59617
cgtatcgcctccctcgcgccatcagacagtatatacacgacggtgctcgattagctgcgtcacgatctctcttggggagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgcctctgattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaaccgaggacacgggcatgtattattgtgttgtgtttatattcaggaactgtcccactggggccagggaccctggtcaccgtctcctcagcctcacaagggccatcggtcttccccctggcgccctgctccaggagcacctcgagagcacagcggccctgggctgcctggtcaaggactacttcctatatactgtctgagcgggctggcaaggcgcatagatc

SEQ ID NO: 792865 - DNA, 622 bp, Homo sapiens
  misc_feature: 59618.44.23.C01.1.pb.heavy.1.raw 59618
cgtatcgcctcctcgcgccatcagacagtatatacacgaccggtgctcgatttagtacacgtgattagggattggggcaggtgaacacctgtggttttcctcctgctggtggcagctcccagatgggtcctgtcccaggtgcagctgcaggagtcgggcccaggactggtgaggccttcgggaaccctgtctctcatctgcactgttctctggagtttcccatcagttctgatcattcttggggctggatccggcagcccccagggaggggaatggagtggagttggtgacatccattatactgggcgatcgctcacactctccgtccctcagagtcgtctcaccatttcgagggacacgtccatgaaccgcttctccctgaaactgacctccgtgaccgccgcggacacggccgtttatttctgtgcgaggcgagactggtctttcaatctatgggggccgtggcacctggtcactgtgctcctcagcttccaccaagggcccatcggtcttcccccctggcgccctgctccaggagcacctctgggggcacagcgccctgggctgcctggtcaaggactacttcctatatactgtctgagcggcgctggcaggcgcatag

SEQ ID NO: 792866 - DNA, 617 bp, Homo sapiens
  misc_feature: 59624.44.23.C01.1.pb.heavy.1.raw 59624
cgtatcgcctcctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792867 - DNA, 696 bp, Homo sapiens
  misc_feature: 59629.44.27.C05.1.pb.heavy.1.raw 59629
ctatgcgccttgccagcccgctcagacagtatataggaagtagtccttgaccaggcagcccagggccgctgtgctctcggaggtgctcctggagcagggcgccaggggaagaccgatgggcccttggtggaggcgaggagacggtgaccagggttcctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacacggcgacttccagtgctgggctcgtctccaggccccaaacccttcgatcgcgtctaaatcgagcaccggtcgtgtatatactgtctgatggcgcgaggaggcgatacg

SEQ ID NO: 792868 - DNA, 707 bp, Homo sapiens
  misc_feature: 59631.44.62.F07.1.pb.heavy.1.raw 59631
cgtatcgcctccctcgcgccatcagacagtatatacacgaccggtgctcgatttagtagtcgcataaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcggcctgggaggtcctgaccctctcctgtgcggcctctggattcacctttagtgctatggcatgacctgggtccgccgggctccagggaggggactggagtgggtctcaagtatcggagctggtggtgtcactttctacggagactccgtgaagggccgcttcaccattttccagggacaattcgcaggacaattgtttctccaaatgaaaaacctgagacccgaggacacaggcgtctattactgtttgaaagccaggaccacggtgacccccatgacacctttagtacttggggccgggggacagtggtgaccgtctcttcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 792869 - DNA, 705 bp, Homo sapiens
  misc_feature: 59641.44.56.F01.1.pb.heavy.1.raw 59641
ctatgcgccttgccagccgctcagacaggtatataggaagtagttccgttgaccaggcagcccagggccccgctgtgcccccagaggtgctcctggagcagggcgccagggaagaccgatggccgcttgtggaagctgaagagacggtgaccatgtgtccctggcccccaatatcaaatgcatcgacgtcccaggatcgcctggcgcagtaatagacgcctgtgtcgtcgggtctcaggttgctcatttgtaaatggccaacactgttggagtcatcccttgagacggtgaatcttccctccagacccggcgtactctttacttccaccataacgtttcattctgacgaaagtgatccactcaagccctccctggagcctgacggacccaggccaagtgataatcactaagactgaatccttgagactcacaggagagtctcagagaccgccctggctgccaagccccccccgactccccagtcgcccctcgcactggacaccttctaaaaaaatacaaggaaaatcaagattagcccaaactccatggttggtggtctgtgctcagtgctgatcacccaagtggaactcctggactcacggctggggctcctctccagagctcccctttgtgtgttcagacgtctgctaaatcgagcaccggtcgtgtatatactgtctgatggcgcgagggaggcccgatacg

SEQ ID NO: 792870 - DNA, 716 bp, Homo sapiens
  misc_feature: 59659.44.27.C05.1.pb.heavy.1.raw 59659
ctatgcgccttgccagcccgctcagacagtatataggaaagtagtccttgaccaggcagcccagggccgctgtgctctcggaggtgctgcctggagcagggcgccagggggaagaccgatgggcccttggtggaggccgaggagagcgggtgaccaaggttcctggccccagcggtcgaatgaaccgattttggaaacagatagtctcgcacaaaaaatacacgccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctgagcctggcgacccactgcatattccaattatcgaaggtgaatccagaggctgcacaggagagtcttcagggacccccctactggggccaacgcccctccccagactccacgaattgcacctgacacatgacacctcttaagagggcaacggaggaaaaacccagctcagcccaaactccatggtgagtcctctgtgttcagtgatgatcaccgagtggaaaccaccggcgacttccagtgctgggctcgtctcccagggctccccaaacccttcgatcgcgtctaaatcgagcaccggtcgtgtatatactgtctgatggcgcgaggggaggcgatacg

SEQ ID NO: 792871 - DNA, 704 bp, Homo sapiens
  misc_feature: 59678.UNK.UNK.UNK.pb.heavy.1.raw 59678
ctatgcgccttgccagcccgctcagacagtatataggaagtagtccttgaccaggcagcccagggccgctgtgcccccagaggtgctcctggagcagggcgccaggggaagaccgatgggcccttggtggagctgaagagacggtgaccattgtcccctgccccaaatatcaaatgcatcgacgtcccagtatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgttcattctgacgaaagtgatccactcaagcccttcctggagcctgacggacccaggccaagtgataatcactaagactgaatcctgagactacacaggagagtctcagagaccgccctggctgtgccaagccccccccccgactccgccagtcgccctcgcactggacaccttctaaaaaactacaggaaaatcaagattagcccaactccatggttggtggtctgtgctcagtgctgatcaccaagtggaaactcctgggaatctcacggctggggctcctctcccagagctcccctttgtgtgttcagacgtctgctaaatcgagcaccgtcgtgtatatactgtctgatggcgcgaggaggcgatacg

SEQ ID NO: 792872 - DNA, 732 bp, Homo sapiens
  misc_feature: 59684.44.74.G08.1.pb.heavy.1.raw 59684
ctatgcgccttgccagcccgctcagacagtatataggaagtagtccttgacccaggcagcccagggggccgctgtgcccccagaggtgctcctggagcagggcgccagggggggaagaccgatgggcccttggtggaagctgaggtgacaatgaccagggttccctgccccagatctcaaaggctccatgcggagctgggtacgggacctctcgcacagtagtaggacggccggccgtgtcggttcgggatttcaaagaacctcattttgtcatggagactgtgtctgtggacttgtccgcggtaatcgtaattctgccccggaagtctcgtgcgtaggtgagtgagccaaaaaagaggggatgattccacccatcccactcaagccctttgtcccagggggggcctggcgcacccagttgatggtataagtagtggaactggtagtacttccagaggccgtgcaggaaaggggtcacgaggaccaaggttgccggcattctagtccccagactgcaccagttgcaccagggggactggacacctgttgctgctgccaccacaaagaggaacctccaggtccagtccatgggtgatgagctgtgctcccagggggcttctttagaggaggaatggtggttgttatgtgatgctccccctgatagagctactaaatcgagcaccggtcgtgtatataactgtctgaatggcgcgagggagggcgatacgatct

SEQ ID NO: 792873 - DNA, 587 bp, Homo sapiens
  misc_feature: 59705.44.78.H01.1.pb.heavy.1.raw 59705
ctatgcgccttgccagcccgctcagacatatataggaagtagtccttgaccaggcagcccagggccgctgtgctctcggaggtgctcctggagcagggcgccaggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctgggaggtgctcctggtcatactaactctgccttggaacttctggcaaagcccgtgttgccactatagggcttcatccatccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttccccccaaacccaaactactcacactaaatcgagcaccggtcgtgtatatactgtctgatggcgcgagggaggcgatacg

SEQ ID NO: 792874 - DNA, 619 bp, Homo sapiens
  misc_feature: 59709.44.23.C01.1.pb.heavy.1.raw 59709
ctatgcgccttgccagcccgctcagacagtatataggaagtagtcctctgaccaggcagcccagggccgctgtgcccccagagggcctggagcaggggcgccaggggagacgatgggcccttggtggaagctgaggagacgacagtgaccagggtgccacgggcccatagttgaaagaccgagtctcgcctcgcacagaaataaacggccgtgtccgcggcggtccacggaggtcagttcagggagaagcggttcatggacgtgtccctcgaaatggtgagacgactcttgagggacggagagtagtacgtcgccccagtataatggatgtcacaatccactccattcccctccctgggggctgccggatccagccccagaatgatcagaactgatggaaactccagagacagtgcagatgagaagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 792875 - DNA, 714 bp, Homo sapiens
  misc_feature: 59727.44.55.E11.1.pb.heavy.1.raw 59727
ctatgcgccttgccagcttgccgctcaggacagatataggaagtagtccttgaccaggcagccccagggccggctgtgccccagacggctgctcttggaggagggtgccagggggcaagaccgatgggcccttggtggaggcggaggcgacggtgccaggttcgctggcgccccagaagtcaaaacgaataataaccactccgagcgcgactgtctcggcgcgcagtaatagacggccgcgtgtcgtcgcctctcaggttgttcatttgaagataaaccgtgttcctggaattgtccctggagatggtgaatcggcccttcacggagtctgcgtagtatgtgaaatcaccagtataatgactgagacccactccagccccttccctggagcctggcgcgccccaacccatgtagttgctgctgacgtgagcccagaggcgtgcacaggaaggttctctgggacccccaggctggactaagcctcctccagactccatcagccgcacctcacactggacacctttttaaagtccaacaggagaaccagctcagccaaaactccatgggccagtcctctgtgtcagtgctgatcacgaatggaaacacctcggaatcccagtgctgggctcctctccccccccaaaccaacgtgcgagtgctaatcgagcaccggtcgtgatagtatagactgatggcgcgagggaggcgaatacg

SEQ ID NO: 792876 - DNA, 699 bp, Homo sapiens
  misc_feature: 59777.UNK.UNK.UNK.pb.heavy.1.raw 59777
ctatgcgccttgccagcccgctcagacagtatataggaagtagtccttgaccaggcagcccagggccgctgtgctctcggaggtgctcctggagcagggcgcagggaagaccgatgggccccttggtggaggctgaggagacggtgaccagggtcccctggccccagtcatgcggcccggtaataactactaccagcctcccgatctcgcacagtaatacagagccgagtctcgactctcaggctgaccatttccaagtacacaatgttccgggaattgtctctggagatggtgaatcgcccttcacggagtctgcataatattcagaacttccatcatgtgctataactgccaacactccggccccttgcctggagcctggcggaccagtgcatgccagaaccactgaaactaaatccagaggcttcacaggagagtctcagggacctcccaggctggaccacgcctcccagactccaccaggtgcacctgacagtggacacctcttaaagagcaacgagaaaaacccagctcagcccaaactccatggtgagtcctctgtgttcagtgctgatcaccgaaatgaaaccacgccgacttctagtgctgggctcctctcccagaccctttcccttcacactacactaaatcgagcacggtcgtgtatatactgtctgatggcgcgagggaggcgatacg

SEQ ID NO: 792877 - DNA, 719 bp, Homo sapiens
  misc_feature: 59865.UNK.UNK.UNK.pb.heavy.1.raw 59865
ctatgcgccttgccagcccgctcagacagtatataggaagtagtccttgacaggcagcccagggccgctgtgctctcggaggtgctcctggagcagggcgccaggggaagaccgatgggcccttggtggaggctgaagagacgcgtcaccactgtccccggccccaagtactaaaggtgtcatgggggggtcaccgtggtcctggttcaaacagtatagaccgcctgtgtcctcgggtctcaggttttcatttggagaacaatttgtcctgccgaattgtccctggaaaatggtggaagcggcccttcgacggagtctccgtagaaagtgacaccaccagctccgatacttgagacccactccagtcccctccctggagccccggcggacccaggtcatgccataggcactaaagggaatccagaggccgcacaggagagggtcagggacctcccaggccgaatcaggcccccccgccagactccaacaactggcacttcacacacgacaccccctttaaaaaagccacaagaaaaggccagctcagcccaaactccatgggagacttctctcgtttcgggtcctgggtcaccaaatgaagacacctgaaaatccagggctgggctcctctctcagagctcccctttccctttatgcgactactaaaatcgagcaccggtcggtgtatatactgtctgatggcgcgaggaggcgatacg

SEQ ID NO: 792878 - DNA, 663 bp, Homo sapiens
  misc_feature: 59879.44.12.B01.1.pb.heavy.1.raw 59879
cgtatcgccttcctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagaacacgtccaagaaccagttctccctgagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggcctgggcttgcctggtcaaggactactttcctatatactgtctgagcgggctggcaaggcgcatag

SEQ ID NO: 792879 - DNA, 612 bp, Homo sapiens
  misc_feature: 59893.UNK.UNK.UNK.pb.heavy.1.raw 59893
cccgacacgcttgctagggacttggagctaaggacgacatattgcctttagacagtcgaaggtgacgcccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccccacatagcctgcttggggtgttgagtttacttttatttcgtgttggaatgagttgaacttccgggaagtggagtaatgggtttgtctacttcccctaaccgcaaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 792880 - DNA, 605 bp, Homo sapiens
  misc_feature: 59895.UNK.UNK.UNK.pb.heavy.1.raw 59895
ccgacacgcttgctagggacttggagctaaggacgaatattgcctttagacagtcgaaggtgacgccttagctaccactgaacgtttaggcgccagatgcggtctgggatgaccttaactcgcagcttatcgatgatctactgcaacgctcaaccaaccaggtcttgatgcgcgcgataggactgacgggatcgctacagacatttaactcgctagtaacttaattgagatcctagggaatgggataggaaatagaatccacccctatcacccccccacatagcctgcttggggtgtgagtttacttttatttcgtgttggaatgagttgaacttccgggaagtggagtaatgggtttgtctacttcccctaaccgcaaagtactagttttacgagtgcgttgcaagccatagccagtcacaggtaataaacaattcaacgtgcgtaaagattggccgcttgctgtgggcattgcaagctgggtttgcagcattgtgcatgctagacgacaatatgaatctgcgggaccctagtggccaagatggccgctagcgggttccgcagctttgacctggaccagggtgcatagcctgcccagccttctc

SEQ ID NO: 792881 - DNA, 712 bp, Homo sapiens
  misc_feature: 59898.44.33.C11.1.pb.heavy.1.raw 59898
ctatgcgccttgccaggccgctcagacagtatataggaagtagtccttgaccaggcagcccagggccgctgtgcccccagaggtgctcttggaggagggtgccaggggaagaccgatgggccttgtggaggctgaggagacggcgaccgtggtccttggccccaggcgtccatacattggagtagagcatgtcatatctgtatccacgagccccatctctcgcacagtagtagacagccgtgtctcggctctcaggctattcatttccagatatagtgtgttcttcgaattgtctctggagatggtgaatcggcccttcacggaatctacataatatttattacttccatcataccatataagtgcccaccactccagtccttgcctggagcctggcggaccagtgcatgccatgtctgttgaaggtgaatccagacgctacacaggagagtctcagggacctcccaggctggaccacgcctccccagactccaccagcttcacctgacactggacacctcttaaagagcaacgaggaaaacccaggtcagcccaaactccatggtgagtcctctgtgttcggtgctgatcaccgactgaaacaccgccgacttctggtgctgggctcctctccagcccaaacccaacgagctcactctaatcgagcaccggtcgtgtatatactgtctgatggcgcgagggaggcgatacg

SEQ ID NO: 792882 - DNA, 702 bp, Homo sapiens
  misc_feature: 59919.UNK.UNK.UNK.pb.heavy.1.raw 59919
ctatgcgccttgccagcccgctcagacagtatataggaagtagtccttgaccaggcagcccagggccgctgtgctctcggaggtgctcctggagcagggcgccaggggaagaccgatgggcccttggtggaggctgagggacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccgttcgtgtatatactgtctgatggcgcgagggaggcgatacg

SEQ ID NO: 792883 - DNA, 705 bp, Homo sapiens
  misc_feature: 59938.44.36.D03.1.pb.heavy.1.raw 59938
cgtatcgcctccctcgcgccatcagacagtatatacacgaccggtgctcgatttagctgcgtcacgtctctcttgggagctctcagagaggtgccttagccctggatttccaagcatttccacttggtgatcagcactgaacacagaggactcaccatggagttggggctgcgctgggttttccttgttgctattttagaaggtgtccactgtgaggtgcggctggtggagtctgggggaggcttggtacagcggggggggggtccctgagactctcctgtgcagctctggatcatcttcagtgactatgccatgaactgggtccgccaggctccagggaaggggctggagtgggtttcatatgttaatattgctggagataccacctactacgcagactctgtgaagggccgattcaccaattccagggacaatgccaagaactcactgtatctggaatgaacagcctgagagacgaggacacggctgtctaacttctgttcgagagatcgggccactggtcagtgctggttttgactactggggcggggaaccctggtcaccgtctcctcagcctccaccaagggcccatcggtcttcccctggcgccctgctccaggagcacctccgagagcacagcggccatgggctgcctggtcaaggactacttcctatatactgtctgagcggctgcaaggcgcatag

SEQ ID NO: 792884 - DNA, 743 bp, Homo sapiens
  misc_feature: 59942.44.73.G07.1.pb.heavy.1.raw 59942
ctatgcgccttgccagcccgctcagacagtatatataggaatgtaagtccttgaccagcgggcagcccagggccgccaagctggtgctctcggaggtgctcctggagcagggcgccagggggaagaccgatgggcccttggtggaggctcgaggagacgggtgacccagccggttctccctgggccccagtgagtcaagcgggggaccgtctcgagggggctctcgcacaataaaatagacagccgtgtcctcacttgtgataggttgtacatttgcagatgcagtgtgttcctgtcctggaattgtctctggagacgggtgaatcggctccttcctcggagtctccgtagtgttctttcaaattccatcttctgatataattgccaccccactccagccccttgcctggagcctggcggacccagtgcatggcataggtcctgaagatgaatccagagggctgcacaggagagtctcagggagttcccaggctgggccgctcctcccccaggaactccactagctgcacctgacactggccacctctttaaaaagagcaacgaggaagaacccatctctagcccagaagtccatggtgagtcctctgtgttcagtgatgatcacccgaatggaaacaccgggcgactctctccagtgctgggctcgtctcccccctgagcgtagagctaaatcgagcaccggtcgtgtatatactgtctgatggcgcgagggaggcgatacg

SEQ ID NO: 792885 - DNA, 708 bp, Homo sapiens
  misc_feature: 59948.44.55.E11.1.pb.heavy.1.raw 59948
ctatgcgccttgccagcccgctcagacagtatataggaagtagtccttgaccaggcagcccagggccgctgtgccccagaggtgctcttggaggagggtgccaaggggggaagaccgatgggcccttggtggaggcggaggcgaccggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtcccctggagatggtgaatcggcccttcacggagtctgcgtagtatgtgaaatcaccagtataaatgactgagacccactccagccccttccctgggagcctggcggacccaactcatgtagttgctgctgacggtgagccccagaggcttgcacaggagagtctctgggaccccccaggctggactaagcctcctccagactccatcagccgcacctcacactggacaccttttaaaagtccaacaaggagaaacccagctcagccaaaactccatggtgagtcctctgtgttcagtgctgatcaccgaatggaaacacctcggaatcccagtgctgggctcctctcccccccaacccaacgtgcgagtgctaaatcgagcaccggtcgtgtatatactgtctgatggcgcgagggaggcga

SEQ ID NO: 792886 - DNA, 708 bp, Homo sapiens
  misc_feature: 59950.UNK.UNK.UNK.pb.heavy.1.raw 59950
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctgggcggacccagtccatatagtggtcactgatggtgaatccagaggcgacacaggagagtctcagggacccctcccaggctggaccaagtctcccccggactccaccaactgcacttcactctggacaccttgtaaaataacacaagggaaaacccagctcagcccgaactccatggtgagtcctctgtgttcagtgctgatcaccaaatgaaaacacctggaattctggggctggggcttccgctctcagagctccccaagagagatcgtgacgcagctaaatcgagcaccgttcgtgtatatactgtctgatggcgcgagggaggcgatacg

SEQ ID NO: 792887 - DNA, 671 bp, Homo sapiens
  misc_feature: 59960.44.12.B01.1.pb.heavy.1.raw 59960
cgtatcgcctccctccgcgccatcagacagtatataccacgaccggtgctcgattagtagtgtagattccggcgggggctttctgagagtcattgaccctcctgtgcaagaacatgaagcacctgtggttcttccctcctgctggtggcggctcccagatgggtcctgtccagctgcagctgcaggagtcgggcccaggactggtgaagccttcggagaccctgtccctcacctgcactgtctctggtggcctccatcagcagtagtagttactactggggctggatccgccagcccccagggaaggggctggagtggattgggagtatctattatagtgggagcacctactacaacccgtccctcaagagtcgagtcaccatatcagtagacacgtcccaagaaccagttctccctgaagctgagctctgtgaccgccgcggacaccggccgtgtattacgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcggggctggcaaggcgcatag

SEQ ID NO: 792888 - DNA, 658 bp, Homo sapiens
  misc_feature: 59975.44.23.C01.1.pb.heavy.1.raw 59975
ctatgccgccttgccagcccgctcagacagtatataggaagtagtccttgaccaggcagcccagggccgctgtgcccccagaggtgctcctggagcaggggcgccaggggaagaccgatgggcccttggtggaagctgaggagaccagtgaccagggtgccacggccccatagattgaaagaccagtctcgcctcgcacagaaataaacggccgtgtccgcggcggtcacggaggtcagttcagggagaagccggttcatggacgtgtccctcgaaatggtgagacgactcttggagggacgagagtagtacgtcgcccagtataatggatgtcaccaatccactccattcccctccctgggggcgccggatccagcccccaagaatgatcagaactgatggaaactccagagacagtgcagatgagagaccagggttcccgaaggcctcaccagtcctgggcccggactcctgcaggctgcacctgggacaggacccatctggggagctgccaccagcaggaggaaaaaccacaggtgcttcatgttcttgcacaggaggtccttgactctcagaaaagcccccaatccctaatcacgtgtactaaatcgagcaccggtcgtgtatatactgtctgatggcgcgaggaggcgatacg

SEQ ID NO: 792889 - DNA, 707 bp, Homo sapiens
  misc_feature: 59984.UNK.UNK.UNK.pb.heavy.1.raw 59984
ctatgcgccttggccagcccgctcagacagtatatacggaagtagtccttgaccaggcagcccagggccgctgctgcctctcggaggtgctcctggagcagggccgccagggggaagaccgatgggcccttggtggaggctgaggagacggtgaccagggttccctggggcccagtggacagttcctgatataaacacaacacaataatacatgcccgtgtcctcggttttcaggttagtcattcgcagaatcaatgagttcttgaagtcatctcttgagagggtgaatctggctttcacagacgcgggcgtactctgtgataaagctggcaactttgtttttactgccggccaagccactccagccccttccctggagcctggcgggacccagtccatatagtgtcactgatggtgaatccagagcgacacaggagagtctcaggaccctccaggctggaccaagtctcccccggactcaccaactgcacttcactctggacaccttgtaaaataacaacaaggaaaacccagctcagcccgaactccatggtgagtcctctgtgttccagtgctgatcaccaaatgaaaaacacctggcgaattctgggctggggctccgctctcccccaagagagatcgtgacgcaggctaatcgagcaccggtcgtgtatatactgtctgatggcgcgaagggaggcgatacg

SEQ ID NO: 792890 - DNA, 654 bp, Homo sapiens
  misc_feature: 59994.44.57.F02.1.pb.heavy.1.raw 59994
cgtatcgcctccctcgcgccatcagacagtatatacacgaccggtgctcgatttagctcgatatagttgggtttgggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctggctgcctggtcaaggactacttcctatatactgtctgagcgggctggcaaggcgcatag

SEQ ID NO: 792891 - DNA, 656 bp, Homo sapiens
  misc_feature: 60031.44.12.B01.1.pb.heavy.1.raw 60031
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccgctgcagctgcaggagtcggcccaggactgtgaagccttcggagaccctgtccctcacctgcactgtctctggtggctccatcagcagtagtagttactactggggctggatcccgccagccccagggaaggggctggagtggattggagtatctattatagtggagcacctactacaacccgtccctcaagagtcgagtcaccatatcagtagacacgtccaagaaccagttctccctgaagctgagctctgtgaccgccgcggacacggccgtgtattactgtgcagagtaggggcagttcgcaccaactactttgacactgggccaggaaccctgggtcaccgtctcctcagcctcacccaagggcccatcggtcttcccctggcaccctcctccaagagcacctctggggcacagcggccctgggctgcctgtcaaggactacttccctatataacctgtctgagcgggctggcaaggcgcatag

SEQ ID NO: 792892 - DNA, 561 bp, Homo sapiens
  misc_feature: 60050.UNK.UNK.UNK.pb.heavy.1.raw 60050
cgtatcgccctcctccgcgccatcagacagtatataacggaccggtgctcgatttagactagcgtaaggggctgaggtgaaagaagcctggggcctcagtgaaggtctcctgcaagggcttctggatacaccttcaccaattatgatattcaactgggtgcgacaggcccactggacaagggcttgagtggatgggatggatgaaccctaacagtggtaacacaggctatgcacagaagttccagggcagagtccaccatgccaggaacaccttccataaacaacagcctacatggagctgagcagcctgagatctgagggacacggccgtgtattactgtgcgagatcccgaaagatagcagctcgtcggggaggtggtcgacccctggggccagggaacccctggtcaccgtcttcctcagctttccaccaaggggcccatcggttcttccccctggcgccctgctccaggagcacctctgggggcacagcggccctggctgcctggtcaaggactacttctataatactgtctgagcgggctggccaaaggcgcatag

SEQ ID NO: 792893 - DNA, 675 bp, Homo sapiens
  misc_feature: 60099.UNK.UNK.UNK.pb.heavy.1.raw 60099
cgtatcgcctccctcgcgccatcagacagtatatacacgaccggtgctcgatttagtgagttcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctgtggagtctgggggaggcgtggtccagcctgggacgtcctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggcgattctccgtctccagagacaattccaagaacaccgtgtatctacaaatgaacatttgagagcgaggactcggctctctattattgtacgagcccatcgttctactggggccaggagccctggtcaccgtctctcagcctcaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 792894 - DNA, 695 bp, Homo sapiens
  misc_feature: 60100.44.27.C05.1.pb.heavy.1.raw 60100
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggtttcctcgttgcctcttaagaggtgtcatgtgtcaggtgcaattcgtggagtctggggaggcgtgccccagtaggggggtccctgagactctcctgtgcagcctctggattcaccttcgataattggaatatgcagtggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccaggaaccctggtcaccgtctcctcggcctccacaagggccatcggtcttccccctggcgccctgctccaggagcacctccgagagcacagcggccctggctgcctggtcaaggactacttcctatatactgtctgagcgggctggcaaggcgcatag

SEQ ID NO: 792895 - DNA, 643 bp, Homo sapiens
  misc_feature: 60126.44.86.H09.1.pb.heavy.1.raw 60126
ctatgcgccttgccagcccgctcagacagtatataggaagtagtccttgaccaggcagcccagggccgctgtgcccccagaggtgctcctggagcaggcgccagggggagacgatgggcccttggtggaagctgaggagacagtgacccagggtgccacgccccatagattgaaagaccagtctcgcctcgcacagaataaacggccgtgtccgcggcggtcacggaggtcagtttcagggagaagcgttcatggacgtgtccctcgaaatgtgagacgactcttgagggacggagagtagtacgtcgcccccagtataatggatgtcacaatccactccattcccctccctggggctgccggatccagccccagaatgatcagaactgatggaaactccagagacagtgccgatgagaggacagggttccgaaggcctcaccagtcctgggcccgaactcctgcagctgcacctgggacagacccatctgggagctgccacagcaggggaaaaaccacaggtgcttcatgttcttgcacaggaggtccttgactctcagaaagcatccccaacccaagtctatagcactaatcgagcaccggtcgtgtatatactgtctgatgggcgcgaggaggcgatacg

SEQ ID NO: 792896 - DNA, 669 bp, Homo sapiens
  misc_feature: 60140.UNK.UNK.UNK.pb.heavy.1.raw 60140
cgtatcgcctcctcgcgccatcagacagtatatacacgaccgtgctcgattagtagctctatcagggggagcatcacataacaaccacattcctcctctaagaagcccctgggagcacagctcatcaccatggactggacctggaggttcctctttgtgtggcagcagcaacaggtgtcagtccctggtgcaactggtgcagtctgggactagaatgccgcaaccttgtcctcggtgaccctttcctgcacggctctggaagtactaccgttccactacttataccatcaactggtgcgccaggcccctggacaagggcttgagtggatgggtggaatcatcctctttttggctcactcacctacgcacgagacttcgggcagaatacgattaccgcggacaagtccacagacacagtctccatgacaatgagttctttgaatcgacgacacggccgtctactactgtgcgaaggtccgtacccaggctcgcatggagccttgagatctggggcagggaaccctggtcattgtcacctcagcttccaccaagggccatcggtcttcctggcgccctgctccagacacctctgggggcacagcggccctgggctgcctggtcaaggactacttcctatatactgtctgagcgggctggcaaggcgcatag

SEQ ID NO: 792897 - DNA, 718 bp, Homo sapiens
  misc_feature: 60188.44.27.C05.1.pb.heavy.1.raw 60188
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggcggtgtcctgaggtctcaggctgttcatttgaagagacactgtgtttctcggaattgtctctggagatggtgaatcggccctcaacggaatcaccgtagactttgatttcctccatgaaatgacacacctgccacccactccagcccctcgcctggagcctggcggaccccactgcatattccaattatcgaaggtgaatccagaggctgcacaggagagtctcagggaccccccctactggggccacgcctcccccagactccacgaattgcacctgacacatgacacctcttaagaggggcaacgaggaaaacccagctcagcccaaactccatggtgagtcctctgtgttcagtgatgatcaccggagtggaaacaccggcgacttccagttgctgggctcgtctccccagggcccccaaacccttcgatcgcgtctaaatcgagcaccggtcgtgtatatactggtctgatggcgcgcgagggaggcgatacg

SEQ ID NO: 792898 - DNA, 713 bp, Homo sapiens
  misc_feature: 60201.44.36.D03.1.pb.heavy.1.raw 60201
cgtatcgccttccctcgctgccatcagacagtatatacacgaccggtgctcgatttagctgcgtcacgatctctcttggggagctctgagagcgggagccccagccccagaattcccaggtgttttcatttggtgatcagcactgaacacagaggacccaccaggagttcgggctgagctggtttttccttgttgttatttttacaaggtgtccagagtgaagtgcagttggtggagtccgggtgagacttggtcccgcctggagggtccctgagactcctcctgtgtcgcctctggattcaccatcagtgaccatatatggactgggtccgccaggctccagggaagggggctggagtggtcttggccgcagtaaaacaaagttgccagctttatcacagagtacgccgcgtctgtgaaagccagattcacccctcaaagagatgacttcaagaactcattgattcttgcgaatgactaacctgaaaaccgaggacacgggcatgtatttattgtgttgtgtttatatcagggaactgtccactggggccagggaaccctggtcaccgtcttcctcagcctccaccaagggcccatcggtcttcccctggcgccctgctccaggagcacctccgagagcacagcggccctgggctgcctggtcaaggactactttcctatatactgtctgagcgggctggcaaggcgcatag

SEQ ID NO: 792899 - DNA, 635 bp, Homo sapiens
  misc_feature: 60208.44.19.B08.1.pb.heavy.1.raw 60208
cgtatcgcctccctcgcgccatcagacagtatatacacgaccggtgctcgatttagtgagtcagtaagggggactccgttgccccaccatggacacactttgctccacgctcctgctgctgaccatccttcatgggcctgtccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaacctggggcagggaatccaggtcaccgtctcatcagcctccaccaaggcccatcggtcttcccctggcgccctgctcaggagcacctccagagcacagcgccctggctgcctggtcaaggactacttcctatatactgtctgagcgggctggcaaggcgcatag

SEQ ID NO: 792900 - DNA, 708 bp, Homo sapiens
  misc_feature: 60248.44.67.G01.1.pb.heavy.1.raw 60248
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaacccactccagccccttccctggagcctggcggacccaactcatgtagttgctgctgacggtgagcccaggaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaatatgtatactctaaatcgagcaccggtcgtgtatatactgtctgatggcgcgagggaggcgatacg

SEQ ID NO: 792901 - DNA, 711 bp, Homo sapiens
  misc_feature: 60249.44.27.C05.1.pb.heavy.1.raw 60249
ctatgcgccttgccagcccgctcagacagtatataggaagtagtccttgaccagggcagccagggccgctgtgctctcggaggtgctcctggagcagggcgccaggggaagaccgatgggcccttggtggaggccgaggagacggtgaccagggttccctggcccaggcgtcgaatgaaccgattttggaacagatagttctcgcacaaaaatacacggccgttgtcctgaggtctcaggctgttcatttgaagagacactgtgttctcggaattgtctctggagatggtgaatcggccctcaacggaatcaccgtagacctttgatttcctccatgaaatgacacacctgcccacccactccagcccctccgcctggagcctggcgacccactgcatattccaattatcggaaggtgaatccagaggctgcacaggagagtctcagggaccccctactgggggccacgcctccccccagactcccacgaattgcacctgacacatgacacctcttaagagggcaacgaggaaaacccagctcagcccaaactccatggtgagtcctctgtgttcaggtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 792902 - DNA, 675 bp, Homo sapiens
  misc_feature: 60272.44.81.H04.1.pb.heavy.1.raw 60272
cgtatcgcctccctcgcgccatcagacagtatatacacgaccggtgctcgatttagtagtgtagattcgcggcggggcggctttctggagagtcatggacctcctgtgccaagaacatgaagcacctgtggttcttcctcctggctggtggcggctcccagatgggtcctgtcccagctgcagctgcaggagtcgggcgccaggactggtgaagccttcggagaccctgctccctcacctgcactgtctctggtggctccatcagcagtagtagttactactgggggctggatccgccagcccccagggaagggctggagtggattgggagtatctattatagtgggagcacctactacaacccgtcccttcagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggcctggcaaggcgcatag

SEQ ID NO: 792903 - DNA, 608 bp, Homo sapiens
  misc_feature: 60307.UNK.UNK.UNK.pb.heavy.1.raw 60307
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgttgagttacttttatttcgtgttggaatgagttgaacttccgggaagtggaagtaatggtttgtctacttcccctaaccgcaaagtactagttttacgagtggcgttgcaagccatagccagtcacaggtaataaacaattcaacgtggcgtaaagattggccgcttgctgtgggcattgcaaagctgggtttgcagcattgtgcatgctagacgacaatatgaatctgcgggacccctagtggccaagatggccgctaagcgggttccgcagctttttgactggaccagggtgcatagcctgcccagccttc

SEQ ID NO: 792904 - DNA, 648 bp, Homo sapiens
  misc_feature: 60321.44.86.H09.1.pb.heavy.1.raw 60321
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttgggctggatccggcagcccccaggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcacgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792905 - DNA, 606 bp, Homo sapiens
  misc_feature: 60323.UNK.UNK.UNK.pb.heavy.1.raw 60323
gaaggctgggcaggctatgcaccctggtccaggtcaaaagctgcggaacccgctagcggccatcttggccactaggggtccgcagattcatattgtcgtctagcatgcacaatgctgcaaacccagctgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaaggcaatatgtcgtccttagctccaagtccctagcaagcgtgtcggg

SEQ ID NO: 792906 - DNA, 720 bp, Homo sapiens
  misc_feature: 60324.44.56.F01.1.pb.heavy.1.raw 60324
ctatgcgccttgccagcccgctcagacagtatataggaagtagtccttgaccaggcagcccaggggccgctgtgcccccagaggtgctcctggagcagggcgccagggggaagaccgatggcccttgtggaagctgaagagacggtgaccattgtcccctggccccaaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagcccccccttccctggagcctgacggacccaggccaagtgataatcactaagactgaatcctgagactacacaggagagtctcagagaccgccctggctgtgccaagcccccccgactccgccagtcgccccctcgcactggacaccttctaaaaaaaactacaaggaaaatcaagattaggcccaaactccatggttggtggtctgtgctcagtgctgatcaccaagtggaaactcctgggaatctcacggctggggcctcctctcccagagctcccctttgtgtgttcagacgtctgctaaatcgagcaccggtcgtgtatatactgtctgatggcgcgagggaggcgatacg

SEQ ID NO: 792907 - DNA, 653 bp, Homo sapiens
  misc_feature: 60342.UNK.UNK.UNK.pb.heavy.1.raw 60342
ctatgcgccttgccagcccgctcagacagtatataggaagtagtccttgaccaggcagcccagggccgctgtgcccagaggtgctcctgagcagggcgccagggggaagacgatgggcccttggtggaagctgaggagacagtgaccagggtgccacggccccatagattgaaagaccagtctcgcctcgccacagaaataacggccgtgtccgccgcggtcacgggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctggacaggaccccatctgggagctgccaccagcaggaggaaaaaccacaggtgcttcatgttcttgcacaggaggtccttgactctcagaaagcatccccaaacccaagtctatagcactaaattcgagcaccggtcgtgtatatactgtctgatggcgcgagggaggcgatacg

SEQ ID NO: 792908 - DNA, 699 bp, Homo sapiens
  misc_feature: 60343.44.55.E11.1.pb.heavy.1.raw 60343
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggcgtgtcgtcgcctctcaggttgttcatttgaagataaaccgtgttcctggaattgtcccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctcccaacccaacgtgcgagtgctaaatcgagcaccggtcgtgtatatactgtctgatggcgcgagggaggcgatacg

SEQ ID NO: 792909 - DNA, 698 bp, Homo sapiens
  misc_feature: 60344.44.55.E11.1.pb.heavy.1.raw 60344
ctatgcgccttgccagcccgctcagacagtatataggaagtagtccttgaccaggcagccagggccgctgtgccccagaggtgctcttggaggagggtgccaggggaagaccgatggcccttggtggaggcggaggcgacggtgaccagggttccctggccccagaagtcaaacgaataataaccactccgagcgccgacttgtctcgcacagcaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaaccaacgtgcgagtgctaaatcgagcaccggtcgtgtatatactgtctgatggcgcgagggaggcgatacg

SEQ ID NO: 792910 - DNA, 546 bp, Homo sapiens
  misc_feature: 60385.44.43.D10.1.pb.heavy.1.raw 60385
ctatgcgccttgccagcccgctcagacagtatataggaagtagtccttgaccaggcagccagggccgctgtgccccagaggtgctcctggagcagggcgccaggggaagaccgatgggcccttggtggaagctgagagacggtgaccagggttccctggccccagggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggccccaggcttcttcacctcagccccttactgctagtctaatcgagcaccggtcgtgtatatactgtctgatggcgcgagggaggcgatacg

SEQ ID NO: 792911 - DNA, 603 bp, Homo sapiens
  misc_feature: 60411.UNK.UNK.UNK.pb.heavy.1.raw 60411
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagcct

SEQ ID NO: 792912 - DNA, 730 bp, Homo sapiens
  misc_feature: 60418.UNK.UNK.UNK.pb.heavy.1.raw 60418
cgtatcgccctcccctcgcgccatcagacagtatatacacgaccggtgctcgatttagccagacgtctgaacacacaaaggggagctctgggagaggagccccagccgtgagattccaggagtttccacttggtgatcagcactgagcacagaccaccaaccatggagttttgggctaatcttgattttccttgtatttttttagaaggtgtccaggtgcgaggggcgactggcggagtcggggggggcttggcacagccagggcggtctctggagactctcctgtgtagtctcaggatttcagctttagtgattatcacttggcctggcgtccgtcaggctccagggaaggggcttgagtggatcacttttcggtcagaaatgaaacgttatggtggaagtaaagagtacgcgcgcgtctgtgaagggaagattcaccgtctcaagggatgactccaacagtgttggccattttacaaatggcaacctgagacccgacgacacaggcgtctattactgcgccaggcgatcctgggacgtcgatgcatttgatatttggggggccaggggacaatggtcaccgtctcttcagcttccaccaagggcccatcggtctttccccctggcgccccctgctccaggagcaacctctgggggcacagcggccctgggctggcctggtcaaggactacttctatatactgtctgagcgggctggcaaggcgcatag

SEQ ID NO: 792913 - DNA, 702 bp, Homo sapiens
  misc_feature: 60478.44.55.E11.1.pb.heavy.1.raw 60478
ctatgcgccttgccagcccgctcagacagtatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 792914 - DNA, 715 bp, Homo sapiens
  misc_feature: 60537.44.74.G08.1.pb.heavy.1.raw 60537
cgtatcgcctcctcgcgccatcagacagtatatacacgaccggtgctcgatttagtagctctatcaggggggagcatcacataacaaccacattcctcctctaaagaagcccctgggagcacaggctcatcaccatggactggacctggaggttcctctttgttggtgggcagcagcaacaggtgtccagtccctggtgcaactggtgcagtctgggactagaatgccgcaaccttggggtcctcggtgaccctttcctgcacggcctctggaagtactaccagttccacttacttttataccatcaactgggtgcgccaggcccctggacaagggcttgagtgtggatgggtggaatcatccctcttttggctcactcacctacgcacgagagcttccggggcagaattacgattaccagcggacaagtccacagacacagtctccatgacaaatgagttctttgaaatccgacgaacacggccgtctactactgtgcgagaggtccgtaccccagctcgcatggagcctttgagatctggggggcagggaaccctgttcattgtcacctcagcttccaccaagggcccatcggtcttacccctggcgccctgctccaggagcacctctgggggcgcaagcggccctgggctgcgctggtcaaggactacttcttataaacctacctgtctgagcgggctggcaaggcgcatag

SEQ ID NO: 792915 - DNA, 707 bp, Homo sapiens
  misc_feature: 60538.44.55.E11.1.pb.heavy.1.raw 60538
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792916 - DNA, 609 bp, Homo sapiens
  misc_feature: 60561.UNK.UNK.UNK.pb.heavy.1.raw 60561
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtacttttgcggttaggggaagtagacaaacccattactccacttcccggaagttcaactcattccaacacgaaataaaagtaaactcaacaccccaagcaggctatgtgggggggtgataggggtggattctatttcctatcccatcccctagatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggccgcctaaacgttcagtggtagctaaggcgtcaccttcgactgtctaaaggcaatatgtcgtccttagctccaagtccctagcaagcgtgtcggg

SEQ ID NO: 792917 - DNA, 608 bp, Homo sapiens
  misc_feature: 60584.44.36.D03.1.pb.heavy.1.raw 60584
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggaagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggattttcgtcattcgagaagatgtgtgtaaagcactccagggccttccctgggggctggacggatccagctcacacccattctaatatcgttgagagagaacccagagatggtgcaggtcagcgtgagggtctctgtgggtttcaccagcacaggaccagactccttcaagtgacctgggacaagacccagagagatcgtgacgcagctaaatcgagcaccggtcgtgtatatactgtctgatggcgcgagggagggcgatacg

SEQ ID NO: 792918 - DNA, 600 bp, Homo sapiens
  misc_feature: 60588.UNK.UNK.UNK.pb.heavy.1.raw 60588
gaaggctgggcaggctatgcacctggtccaggtcaaaagctgcgaacccgctagcggccatcttggccactagggtcccgcagattcatattgtcgtctagcatgcacaatgctgcaaacccagcttgcaatgcccacagcaaagcggccaatctttacgccacgttgaattgtttattacctgtgactggctatggcttgcaacgcactcgtaaaactagtaactttgcggttaggggaagtagacaaacccattactccacttcccggaagttcaactcattccaacacgaaaaaaagtaaactcaacaccccagcaggctatgtgggggggtgataggggtggattctatttcctatccatccctaggatctcaattaagttactagcgagttaaatgtctgtagcgatccgtcagtcctatcgcgccatcaagacctggttggttgagcgtgcagtagatcatcgataagctgcgagttaggtcattcccagaccgcatctggcgcctaacgttcagtggtagctaaggcgtcaccttcgactgtctaaaggcaatatgtcgtccttagctccaagtccctagcaagcgtgtcggg

SEQ ID NO: 792919 - DNA, 704 bp, Homo sapiens
  misc_feature: 60594.44.27.C05.1.pb.heavy.1.raw 60594
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtaggggggtccctgagactcttcctgtgcagcctctggattcaccttcgataattggaatatgcagttgggtccgccaggctccaggcgaggggctgagtgggtggcaggtggtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaaatcggttcattcgacgcctggggccagggaaccctggtcaccgtctcctcggcctccaccaagggcccatcggtcttcccctggcgccctgctccaggagcacctccgaagcacagcggccctggctgcctggtcaaggactacttcctatatactgtctgagcgggctggcaaggcgcatag

SEQ ID NO: 792920 - DNA, 610 bp, Homo sapiens
  misc_feature: 60603.UNK.UNK.UNK.pb.heavy.1.raw 60603
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtccaccttcgactgtctaaaggcaatatgtcgtccttagctccaagtccctagcaagcgtgtcggg

SEQ ID NO: 792921 - DNA, 716 bp, Homo sapiens
  misc_feature: 60606.UNK.UNK.UNK.pb.heavy.1.raw 60606
cgtatcgcctccctcgcgccatcagacagtatatacgcacgacgcgggtgctcgatttagcactcgcacgtgggtttgggggggagaggagcccagcactgggattccgagtggtttccattcggtgatcagcactgaacacagaggactcaccatggagttttggctgagctgggggttctccttgttggacttttaaaaggtgtccagtgtgaggtgcggctgatggagtctggaggaggcttagtccagcctgggggtccccagagactctcctgttgcagcctctggggctcaccgtcagcagccaactacatgagttgggtccgccaggctccagggaagggctggagtgggtctcagtcatctatactggtgatttcacatactacgcagactcgcgtgaagggccgattcaccatctccagggacaattccaggaaacacgggtttatcttcaaatgaacaacctgagaggcgacgacacggccgtctattactgtgcgagacaagtcggcgctcggagtggttattatcgtttgacttctggggccagggaaccctggtcagccgtcgcctccgcctccaccagggccatcggtcttcccccctggcaccctcctccaagagcacctctggggggcacagcggccctgggctgcctggtcaaggactacttcctatatactgtctgagcgggctggcaaggcgcatag

SEQ ID NO: 792922 - DNA, 698 bp, Homo sapiens
  misc_feature: 60615.44.36.D03.1.pb.heavy.1.raw 60615
ctatgcgccttgccagcccgctcagacagtatataggaagtagtccttgaccaggcagcccaggccgctgtgctctcggaggtgctcctgagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggcaagccactcagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaaccagctcagccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 792923 - DNA, 572 bp, Homo sapiens
  misc_feature: 60616.44.78.H01.1.pb.heavy.1.raw 60616
ctatgcgccttgccagcccgctcagacagtatataggaagtagtccttgaccaggcagtccagggccgctgtgctctcggaggtgctcctggagcagggcgccagggggaagaccgatgggccccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactactctgccttggaacttctgggcaaagcccgtgttgccactatagggcttcatccatcccatccactccagcccttgtccagcggcctgtcgcacccagttaatatcatattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 792924 - DNA, 682 bp, Homo sapiens
  misc_feature: 60617.44.45.E01.1.pb.heavy.1.raw 60617
cgtatcgcctccctcgcgccatcagacagtatatacacgaccggtgctcgatttagtgagtcagtaagggaaaaggggctgggagaggagcccagcactagaagtcggcggtgttttccattcgggtgatcagcactgaacacagagggactccatggggaagttcggggcctgagctgggttttcctcgttgctcttttaagaggtgtccagtgtcaggttcagctggtggagtctgggggaggcgtggtccagctggacgtcctgagactctcctgtgttgcgtccggactcagtttcagtgactctgccatgcactgctccgccaggctccaggcaaagggctgagtggggggcagtcatcggtctgatgaagtaggaaagaatactatggaaactccgtgaagggccgattctccgtctccagagacaattcaagaacaccgtgtatctacaaaatgaacaatttgagagccgaggactcggctctctattattgtacgagcccatcgttctactgcggccagggagccctgtcaccgtctcctcagcctccaccaagggccatcggtcttccccctggcgccctgctccaggagcacctcgagagcacagcgccctgggctgcctggtcaacgactacttcctatatactgtctgagcgggctggcaaggcgcatag

SEQ ID NO: 792925 - DNA, 693 bp, Homo sapiens
  misc_feature: 60629.UNK.UNK.UNK.pb.heavy.1.raw 60629
ctatgcgcccttgccagcccgctcagacagtatataggaagtagtccttgaccaggcagcccaggcccgctgtgctctcggaggtgccccctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttcatagtattctttacttccatcagaccagatgactgcccccactccagcccccttgcctggagccctggcggacccagtgcatgggcagagtcactgaaactgagtccgggacgcaacacaggagagtctcagggacgtcccaggctggaccacgcctcccccagactccaccagctgaacctgacactggacacctcttaaaagagcaacgaggaaaacccagctcagcccaaacctccatggtgagtcctctgtgttccagtgctgatcaccgaatggaaaacccgccgacttctagtgctgggctcctcccagccccctttcccttacctgaactcactagcatcggagcacggtcgtggtatatactgtctgatgcgcccgagggagcgcgatacg

SEQ ID NO: 792926 - DNA, 652 bp, Homo sapiens
  misc_feature: 60642.44.86.H09.1.pb.heavy.1.raw 60642
cgtatcgcctcgcctcgcgccatcagacagtatatacacgaccggtgctcgattagtgctatagacttgggtttggggatgctttctgagagtcaaggacctcctgtgcaagaacatgaagcacctgtggtttttcctcctgctggtggcagctcccagatggggtcctgtcccaggtgcagctgcaggagtcgggccaggactggtgaggccttcgggaaccctgtctctcatcctgcactgtctctggagtttccatcagttctgatcattcttgggggctggatccggcagcccccagggaggggaatggagtgattggtgacatccattatactggggcgacgtactactctcccgtccctcaagagtcgtctcaccatttcgagggacacgtccatgaaccgcttctccctgaaactgacctccgtgaccgcgcgcgacacggccgtttatttctgtgcgaggcgagactggtctttcaatctatggggcgtggcaccctggtcactgtctcctcagcttccaccaggccatcggtcttccccctggcgccctgctccaggagcacctctggggcacacggccctggcgctgcctggtcaaggactacttcctatatactgtctgagcgggctggcaaggcgcatag

SEQ ID NO: 792927 - DNA, 709 bp, Homo sapiens
  misc_feature: 60739.44.84.H07.1.pb.heavy.1.raw 60739
ctatgcgccttgccagccgctcagacagtatataggaagtagtccttgaccaggcagcccaggccgctgtgcccccagaggtgctcttggaggagggtgccagggggaagaccgatgggcccttggtggaggctgcggcgacggtgaccagggctccctggccccaggagttgaaccacccacccactgtggatccagtcccccccctcttcgcacagaaataaagggccgtgtcttcgactctcaggctgttcatttccagaaaaagtgtgtttccggaattgtctctggagatggtgaagcggcccttcacggactctccgtagtatgtgtcagttgcactagcgccaattgtcgagacccactcgagccccttcctggagcctggcggacccaggtcatggcatagctcctaaaggggaagccagaggctgcacaggagagtctcagggaccccccaggctgtgccaatcctcccccagactccaacagggccacctcacactggacacctttaaaatagtcacaagaaaaagccacccagcccaaactccatggtgagttctctctgttcagtcctgatcaccaaatgaaaacacctgaaaatcccagggctgggctcctctctcagagctccccgcgacagacgtctgctaaatcgagcaccggtcgtgtatatactgtctgatggcgcgagggaggcgatacg

SEQ ID NO: 792928 - DNA, 684 bp, Homo sapiens
  misc_feature: 60744.44.78.H01.1.pb.heavy.1.raw 60744
ctatgcgccttgccagccgctcagacagtatataggaagtagtccttgaccaggcagccagggccgctgtgctctcggaggtgctcctggagcagggcgccaggggaagaccgatgggccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactcagcccttccctggagcctggcggaccaggtcatccaggcgttactgaaagtgaatccagaggctgcacaggagagtctaaggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctggaatcccaaggctggggctctctcccagagctcccaaacccaaactactcacactaaatcgagcaccggtcgtgtatatactgtctgatggccgcggagggaggccgatacg

SEQ ID NO: 792929 - DNA, 696 bp, Homo sapiens
  misc_feature: 60747.44.36.D03.1.pb.heavy.1.raw 60747
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcgtttcaggttagtccattcgcagaaatcaatgagttcttgaagtcatctcttgagagggtgaatctggctttcacagacgcggcgtactctgtgataaagctggcaactttgtttttactgcggccaagccactccagcccttcctggagcctggcggaccccagtccatatagtggtcactgatggtgaatccagaggcgacacaggagagtctcaggaccctccaggctggaccaagtctcccggactcacaactgcacttcactctggacaccttgtaaaataacaacaaggaaaacccagctcagccgaactccatggtgagtcctctgtgttcagtgctgatcaccaaatgaaaacacctgggaattctgggctggggctccgctctcagagctcccaagagagatcgtgacgcagctaatcgagcaccggtcgtgttatatactgtctgatggcgcgagggaggcgatacg

SEQ ID NO: 792930 - DNA, 678 bp, Homo sapiens
  misc_feature: 60768.UNK.UNK.UNK.pb.heavy.1.raw 60768
ctatggcccttgccagccgctcagacagtatataggaagtagtccttgccaggcagcccagggccgctgtgctctcggaggtgctcctggagcagggcgccaggggaagaccgatgggccctgtggaggctgaggagacggtgaccaggttccctggccgaatgaaaccatcccagacagtaatagacggctgtgtcctcgtgttcaggctgttcatctgcagagacaccgtatcttttgaatcatctcttgagatggtgaatctgccttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaaggactccccaggctttaccaaacctcccccagactccaccaactgcacctcacactggacaccttttaaaatgcagcaaggaaaatccagctcagcccaaactccatggtgagtcctctgtgtcagtcctgatcactgaatgaaaacacctggaatcccaaggctggggctcctctcccagagctcccaaacccaaactactcacactaaaatcgagcaccgtcgtgtatatactgtctgatggcgcgagggaggcgatacg

SEQ ID NO: 792931 - DNA, 642 bp, Homo sapiens
  misc_feature: 60772.UNK.UNK.UNK.pb.heavy.1.raw 60772
ctatgcgccttgcagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcgtcacggaggtcagtttcagggagaagcggttcatggacgtgtcctcgaaatggtgagacgactcttgagggacggagagtagtacgtcgcccagtataatggatgtcaccatccactccattcccctcctggggctgcggatccagccccaagaatgatcagaactgatggaaactccagagacagtgcagatgagaggacagggttcccgaaggcctcaccagtcctgggccgactcctgcagctgcacctgggacaggacccatctggggctgccaccagcaggagaaaaaccacaggtgcttcatgttcttgcacaggaggtccttgactctcagaaagcccccaatccctaatcacgtgtactaaatcgagccaccggtcgtgtatatactgtctgatggcgcgaggaggcgatacg

SEQ ID NO: 792932 - DNA, 608 bp, Homo sapiens
  misc_feature: 60775.UNK.UNK.UNK.pb.heavy.1.raw 60775
cgtatcgcctccctcgcgccatcagacagtatatacacgaccggtggctcgatttagctgcgtcacgatctctcttggtcttgtcccaggtcaccttgaaggagtctggtcctgtgctggtgaaacccacagagaccctcacgctgacctgcaccatctctgggttctctctcaacgatatagaatgggtgtgagctggatccgtcagcccccagggaaggccctggagtggcttgcacacatcttctcgaatgacgaaaaatcctacagtacatctctgagagcagtttaaccatctccaaggacacctccaaaaaggcaggtggtcttttagtatgaccaacatggacccctgcggacacaggcacatattactgtgcacgggtaatgcgggaaagaaacagctggtttctgtattataagtcttaccatctggacgtctggggcaaagggacccacggtcaaccgtctcctcagcttccacaagggcccatcggtcttccccctggcgccctgctcaggagcacctcttggcacagcggccctgggctgcctggtcaaggactacttcctatatactgtctgagcgggctggcaaggccgcatag

SEQ ID NO: 792933 - DNA, 666 bp, Homo sapiens
  misc_feature: 60790.UNK.UNK.UNK.pb.heavy.1.raw 60790
ctatgcgccttgccagcccgctcagacagtatataggaagtaagtccttgaccaggcagcccagggccgctgtgcccccccagaggtggctcctggagcagggcgccagggggaagaccgatgggcccttggtggaagctgaggagacagtgacccaggggtgccacggccccatagatttgaaagaccagtctcgcctcgcacagaaataaacggccgtgtccgcggcgtcacggaggtcagtttcagggagcaagcggttcatggaccgtgtcctcgaaatggtgagaacgactcttgagggacggagaagtagtacgtcgcccccccagtataatggatgtcaccaatccactccattccctccctgggggctgccggatccagccccaagaatgatcagaactgatgaaactccagagacagtgcagatgagagacagggttcccgaagcctcaccagtcctgggcccgactcctgcagctgcacctgggacaggaccatctgggagctgccaccagcaggaggaaaaaccacaggtgcttcatgttcttgcacaggaggtccttgactctcagaaagccccccaaatccctaatcacgtgtactaaatcgagcaccggtcggtgtatatactgtctgatggcgcgagatggaggcgatacg

SEQ ID NO: 792934 - DNA, 681 bp, Homo sapiens
  misc_feature: 60795.44.73.G07.1.pb.heavy.1.raw 60795
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagtgtcccctggccccagtgaaacgcccgataatagctgctgcacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctccaggctggaccacgcctcccccagactccaccaggtgcacctgacactgacacctcttaaaagagtaacgaggaaaacccagctcagcccaaactccatggtgagtcctctgtgttcagtgctgatcaccgaatggaaacaccgccgagagcacagcggccctgagcgtagagctaaatcgagcaccggtcgtgtatatactgtctgatggcgcgagggaggcgatacg

SEQ ID NO: 792935 - DNA, 545 bp, Homo sapiens
  misc_feature: 60810.44.38.D05.1.pb.heavy.1.raw 60810
cgtatcgcctcctcgcgccatcagacagtatatacacgaccggtgctcgatttagtatctgatagttgggtttgggggtccctgagactctcctgtgcagcctctggattcaccttcagtagctactggatgcactgggtcccgccaagctccagggaaggggctggtgtgggtctcacgtattaatagtgatgggagtagcacaagctacgcggactccgtgaagggccgattcaccatctccagagacaacgccaagaacaccgctgtatctgcaaatgaacagtctgagagccgaggacacggctgtgtattactgtgcaagagccggtgcgggagttcggggagttgcatactactactacggtatggacgttctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcata

SEQ ID NO: 792936 - DNA, 696 bp, Homo sapiens
  misc_feature: 60820.UNK.UNK.UNK.pb.heavy.1.raw 60820
cgtatcgcctccctcgcgcgccatcagacagtatatacacgaccggtgctccgatttagtagctctatcagggggagcatcacataacaaccacattcctcctctaaagaagcccctgggagcacagctcatcaccatggactggacctggagggttcctcttgtgtggcagcagcaacaggtgtccagtccctggtgcaactggtgcagtctgggactagaatgccgcaaccttggtcctccgtgaccctttcctgcacggcctctggaagtactaccagttccactacttataccatcaactgggtgcgccaggcccctggacaagggcttgagtggatgggtggaatcatccctcttttggctcactcacctacgcacgagacttccgggcagaattacgattaccgcggacaagtccaccagaccacagtctccatgacaatgagttctttgaaatccgacgacacggccgtctactactgtgcgagaggtccgtacccccagctcgcatggagcctttgagatctgggggcagggaaccctggtcattgtcacctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 792937 - DNA, 660 bp, Homo sapiens
  misc_feature: 60840.UNK.UNK.UNK.pb.heavy.1.raw 60840
ccggtatcggcctcctcgcgccatcagacagtatatacacggaccggtgctcgatttagtagtgtagattccgcgggctttctgagagtcatggacctcctgtgcaagaacatgaagcacctgtggttcttcctcctgctggtggcggctcccaagatggtcctgtcccagctgcagctgcaggagtcgggccaggactggtgaagccttcggagaccctgtcctcacctgcactgtctctgtggctccatcagcagtagtagttactactggggctggatccgccagcccccagggaagggctggagtgatgggagtatctattatagtggagcacctactacaacccgtcctcaagagtcgagtcacgcatctcagtagaacgttccaagaaccagttctccccgaaagctgaggctcgtggccgccgcggacacggccgggtattactggtgcgagagtagggcagttcgtcaccaactactttgaccactgggccagggaacctggtcaccgtctcctcagcctccgaccaagggcccatcggtcttcccctggcaccctcctccaagagcacctctggggcacagcggccctgggctgcctggtcaaggactacttcctatatactgtctgagcgggctggcaagggcgcgatgg

SEQ ID NO: 792938 - DNA, 660 bp, Homo sapiens
  misc_feature: 60869.44.57.F02.1.pb.heavy.1.raw 60869
ctatgcgccttgccagccgctcagacagtatataggaagtagctccttgaccaggcagccagggccgctgtgcccccagaggtgctcctggaggcaagggcggccaggggggaagaccgatgggcccttggtggaagctgaggagaccagtgacccagggtgcacggcccatagatgaaagaccagtctccgcctcgcacagaaataaacggccgtgtccgcggcggtcacggaggtcagtttcagggagaagcggttcatggacgtgtcccccgaaaggtgagacgactcttgagggacggagagtagtacgtcgccccagtataatggatgtcaccaatccacttccattcccctccctgggggccgccgatccagcccccaagaatgatcagaactgatggaaactccagagacagtgcagatgagagacagggttcccgaaggcctcaccagtcctgggccgactccctgcagctgcacctgggacaggacccatctgggagctaccaccagcaggaggaaaaaccacaggtgctttcatgttcttgcacaggaggtcctttgactctcagaaagcatcccaaacccaactatatcgagctaaatcgagcaccggtcgtgtatatactgtctgatggcgcggagggaggcgatacg

SEQ ID NO: 792939 - DNA, 700 bp, Homo sapiens
  misc_feature: 60872.UNK.UNK.UNK.pb.heavy.1.raw 60872
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttcctggcccagaagtcaaacgaataataaccactccgagcgccgacttgtctcgcacagtaatagacggccgtgtcgtcgcctctcaggttgttcattgaagataaaccgtgttcctggattgtccctggagatggtgaatcggcccttcacggagtctgcgtagtatgtgaaatcaccagtataaatgactgagaacccactccagccccttccctggagcctggcggacccaactcatgtagttgctgctgacggtgagcccagaggctgcacaggagagtctctggacccccaggctggactaagcctcctccagactccatcagccgcactcacactggacacctttaaaagtccaacaaggagaaccccagctcagccaaaactccatggtgagtcctctgtgttcagtgctgatcaccgaatggaaacacctcggaatcccagtgctgggcctcctctccccccaaacccaacgtgcgagtgctaaatcgagcaccggtcgttgtatatactgtctgatggcgcgagggaggcgatacg

SEQ ID NO: 792940 - DNA, 709 bp, Homo sapiens
  misc_feature: 60874.44.55.E11.1.pb.heavy.1.raw 60874
ctatgcgccttgccagcccggctcagacagtatataggaagtagtccttgaccaggcagcccagggccgctgtgcccccagaggtgctcttggaggagggtgccagggggaagaccgatggcccttggtggaggcggaggcgacggtgaccagggttcctggccccagaagtcaaacgaataataaccactccgagcgccgacttgtctcggcacagtaatagacggccgtgtcgtcgcctctcaggttgttcatttgaagataaaccgtgttcctggaattgtccctggagatggtgaatcggcccttcacggagtctggcgtagtatgtgaaatcacagtataaatgactgagacccactccagccccttccctggagcctggcggacccaactcatgtagttgctgctgacggtgagcccagaggctgcacaggagagtctctgggacccccccaggctggactaagcctcctccagactccatcagcgcccaccttcacactgggacaccttttaaaagtccaacaaggagaacccagctcagccacaaactccattggtgagtcctctgtgttcagtgctgatcaccgaatggaaacacctcggaatcccagtgctgggctcctctccccaaaacccaacgtgcgagtgctaatcgagcaccggtcgtgtatatactgtctgatggcgcgagggaggcgatacg

SEQ ID NO: 792941 - DNA, 709 bp, Homo sapiens
  misc_feature: 60878.44.62.F07.1.pb.heavy.1.raw 60878
cgtatcgcctcccctcgcgccatcagtctatactatcacgaccggtgctcgatttagtagtcgcataaagggaaagggggagctctgagagaggagcccagccctgggattttcaggtgtcttcatttggtgaccaggaccgaacagagagaagtctccatggagtttgggctgagctgcctttttcttgtggctttttaaaggggtgtcgtgtgtgaagtgcagttgttggagtctgggggggcctgattcggcctgggaggtccctgaccctctcctgtgcggcctctggattcacctttagtgcctatggcatgacctgggtccgccgggctccagggagggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccggggggacagtggtgaccgtctcttcagcctccaccaagggcccatcggtcttccccctggcgccctgctccaggagcacctccgagagcacagcggccctgggctgcctggtcaaggactacttcccctatatactgtctgagcgggctggcaaggc

SEQ ID NO: 792942 - DNA, 695 bp, Homo sapiens
  misc_feature: 60879.44.45.E01.1.pb.heavy.1.raw 60879
cgtatcgcctccctcggccatcagacagtatatacacgaccggtgctcgatttagtgagtcagtaagggaaaggggctgggagaggagcccagcactagaagtcggcggtgtttccattcgggtgatcaggcactgaacacagagcgaactcaccatggagtttggcgctgagctgggtttctcctcgttgctctttaagaggtgtccagctgtcaggttcaggctggtggagtctgggggaggcgtggtccagcctgggacgtccctgagactgctcctgtgttgcgtccggactcagtttcagtgactctgccatgcactgggtcccgccaggcctccaggcaaggggctggagtgggtggcagtcatctgggtctgatggaagtaaagaatactatggaaactccgtgaagggccgattctccgtctccagagacaattccaagaacaccgtgtatctacaaatgaacaatttgagagccgaggactcggctctctatattgtacgcgagcccatcgttcctactggggcccagggagccctggtcaccgtctcctcagccccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792943 - DNA, 737 bp, Homo sapiens
  misc_feature: 60893.44.85.H08.1.pb.heavy.1.raw 60893
gcgccttgccagcccgcctcagacaggtatataggaggaagtagtccttgaccaggcagcccagggccgctgtgcccccagaggtgctcttggaggagggtgccagggggaagaccgatgggcccttggtggaggcctgaggagacggtgaccggtgggggggtcccttggccccagacgtccataccgtagtagtagtcccagcaggtggtagtactacaatatgtcctcgcacagttaatacacagccgtgtcctcggctctcaggctgttcatttgcagatacagcgtgttcttggaattgtctctggagatggtgaatcggcccttcacggagtctgcatagatttattactttccatcataccatataagtgccacccactccagcccctttgcctggagctggcggacccagtgcatgccatagggtactgaaggtaatccagacgctgcacaggagagtctcagggagcctccaggcgggaccacgcctcccccagactccaccagctgcacctgacactggacacctcttaaaagagcaacgaggaaaccagctcagcccaacactccatggtgaggtcctctgtgttcagtgctggatcaccgaatggaaacaccgccgacttctagtgctgggctcctctcccagagctcccgcgactgagtgatactaatcgagcaccggtcgtgatagtatagacactgatggcgcggcggagggaggcgatacg

SEQ ID NO: 792944 - DNA, 699 bp, Homo sapiens
  misc_feature: 60910.UNK.UNK.UNK.pb.heavy.1.raw 60910
ctatgcgccttgccagcccgctcagacagtataataggaagtagtcttgaccaggcagcccaggccgctgtgcccccagaggtgctcttggaggagggtgccaggggaagaccgatgggcccttggtgggaggcggaggcgacggtgacagggttccctgccccagaagtcaaacgaataataaccactccgagcgccgacttgtctcgcacagtaatagacggccgtgtcgtcgcctctcaggttgtcatttgaagataaaccgtgttcctggaattgtcctgggagatggtgaatcgcccttcacggagtctggcgtagtatgtgaaatcaccagtataaatgactgagacccactccagccccttccctggagcctggcggcccaactcatgtagttgctggctgacggtgagcccagagcctgcaccaggagagtctctggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacactcgaatcccagtggctggctcctctcccccccaagcccaacgtgcgagtgcaaatcgagcaccggtcgtgtatatactgtctgatggcgcgaggagggcatacg

SEQ ID NO: 792945 - DNA, 706 bp, Homo sapiens
  misc_feature: 60931.44.55.E11.1.pb.heavy.1.raw 60931
ctatgcgccttgccagccgctcagacagtatataggaagtagtccttgaccaggcagcccagggccgctgtgcccccagaggtgctcttggaggagggtgccagggggagaccgatgggcccttggtggagcggaggcgacggtgaccagggttccctggccccagaagtcaaacgaataataaccactccgagcgccgacttgtctcgcacagtaatagacggccgtgtcgtcgcctctcaggtttgttcatttgaagataaaaccgtgttcctggaatgtccctggagatggtgaatcggcccttcacggagtctgcgtagtatgtgaaatcaccagtataaatgactgagaacccactccagccccttccctggagcctggcggacccaactcatgtagttgctgctgacggtgagcccagagctgcacaggagagtctctgggaccccccaggctggactaagcctcctccagactccatcagccgcacctcacactggacaccttttaaaagtccaacaaggagaaacccagctcagccaaaactccatggtgagtcctctgtgttcagtgctgatcaccgaaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 792946 - DNA, 676 bp, Homo sapiens
  misc_feature: 60936.44.21.B10.1.pb.heavy.1.raw 60936
ctatgcgccttgccagcccgctcagacagtatataggaagtagtccttgaccaggcagcccagggccgctgtgccccagaggtgctcctgagcagggcgccaggggagaccgatgggcccttggtggaagctgaagagacgggtgaccattgtcccctgccccaaatatcaaatgcatcgacgtccaggatcgcctggcgcagtaatagacgcctgtgtcgtggggtctcaggtgctcattgtaaatggccaacactgtgagtcatcccttgagacggtgaatcttcccttcacagacgcggcgtactctttacttccaccataacgtttcattctgacgaaagtgatccatcaagcccttccctggagcctgacggacccaggccaagtgataatcactagactgaatcctgagactacacaggagagtctcagagaccgccctggctgtgcaagcccccccgactccgccagtcgccctcgcactggacaccttctaaaaaaactacaagaaaatcaagattagcccaaactcatggttggtggtctgtgctcagtgctgatcaccaagtggaaactcctgggaatctcacgctggggctctctctcttgcgacgacactaaatcgagcaccggtcgtgtatatactgtctgatggcgcgagggaggcgatacg

SEQ ID NO: 792947 - DNA, 696 bp, Homo sapiens
  misc_feature: 60985.UNK.UNK.UNK.pb.heavy.1.raw 60985
ctatgcgccttgccagcccgctcagacagtatataggaagtagtccttgaccaggcagccagggccgctgtgctctcggaggtgctcctggagcagggcgccaggggaagaccgatgggcccttggtggaggccgaggagacggtgaccagggttcctggccccaggcgtcgaatgaaccgattttggaaacagatatctgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggaccactgcatattccaattatcgaaggtgaatccagaggctgcacaggagagtctcagggacccccctactgggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctggctcgtctcccagccccaaaccccttcgatcgcgtctaaatcgagcacggtcgtgtatatactgtctgatggcgccgagggaggcgatacg

SEQ ID NO: 792948 - DNA, 704 bp, Homo sapiens
  misc_feature: 60993.44.70.G04.1.pb.heavy.1.raw 60993
ctatgcgcctttgccagccgctcagacagtatataggaagtagtccttgaccaggcagcccagggccgctgtgctctcggaggtgctcctggagcagggcgccagggggaagaccgatgggcccttggtggaggctgaggagacggtgaccagggtccccctggcccagtcatgcgcccggtaataactactaccacctcccgatctcgcacagtaatacagagccgagtcctcgactctcaggctgaccatttccaagtacacaatgttccgggaattgtctctggagatggtgaatcggcccttcacggagtctgcataatattcagaacttccatcatgtgctataactgccaaccactccggccccttgcctggagcctggcggacccagtgcatgccagaaccactgaaactaatccagaggcttcacaggagagtctcagggacctcccaggctggaccacgcctccccagactccaccaggtgcacctgacagtggacacctcttaaagagcaacgaggaaaacccagctcagcccaaactccatggtgagtcctctgtgttcagtgctgatcaccgaatggaaacaccgccgacttctagtgctggctcctctcccagacccctttcccttcacactacactaaatcgagcaccggtcgtgtatatactgtctgatggcgcgagggaggcgatacg

SEQ ID NO: 792949 - DNA, 714 bp, Homo sapiens
  misc_feature: 60998.44.85.H08.1.pb.heavy.1.raw 60998
ctatgcgccttgccagcccgctcagacagtatataggaagtagtcttgaccaggcagcccagggccgctgtgcccccagaggtgctcttgaggagggtgccaggggaagaccgatgggcccttggtggaggctgaggagacggtgaccgtggtcccttggccccagacgtccataccgtagtagtagtcccagcaggtggtagtactacatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagcccttgcctggagcctggcggacccagtgcatgccataggtactggaaggtgaatccagacgctgcacaggagagtctcagggacctccaggctggaccacgcctcccccagactccaccagctgcacctgacactggacacctcttaaagagcaacgaggaaacccagctcagcccaaactccatggtgagtcctctgtgttcagtgctgatcaccgaatggaaacaccgccgacttctagtgctgggctcctctccagagctccccgcgactgagtgatactaaatcgagcaccggtcgtgtatatactgtctgatggcgcgaggaggcgatacg

SEQ ID NO: 792950 - DNA, 677 bp, Homo sapiens
  misc_feature: 61008.44.53.E09.1.pb.heavy.1.raw 61008
cttatgcgccttgccagcccgctcagacagtatataggaagtagtccttgaccaggcagcccagggccgctgtgctctcggaggtgctcctggagcagggcgccagggggaagaccgatgggccttggtggaggcctgaggagacggtgaccagggttccctgcccgaatgaaaccatcccagacagtaatagacggctgtgtcctcggtgttcaggctgttcatctgcagaacaccgtatcttttgaatcatctcttgagatggtgaatctgcctttcacgggtgcagcgtagtctgctgtcccaccgtcaggctttggttctaatacggccaacccactccagccccttccctggagcctggcggacccaggtcatccaggcgttactgaaagtgaatccagaggctgcacaggagagtctaaggactccccaggctttaccaaacctcccccagactccaccaactgcacctcacactggacaccttttaaaatagcagcaggaaatccagctcagcccaaactccatggtgagtcctctgtgttcagtcctgatcactgaatgaaacacctgggaatcccaaggctggggctcctctccagagctcaacacactctctctaaatcgagcaccggtcgtgtatatacgtctgatggcgcgagggaggcgatacg

SEQ ID NO: 792951 - DNA, 690 bp, Homo sapiens
  misc_feature: 61020.UNK.UNK.UNK.pb.heavy.1.raw 61020
cgtatcgcctcctcgcgccatcagacagtatatacacgaccccgtgctcgatttagttgtcgtcgcaagagagaggagccccagccgtgagattcccaggagtttccactttggtgatcagcactgagcacagacccaccaaccatggagttttgggctaatcttgatttccttgtagttttttttagaaggtgtccagtgcgagggcgactggcggagtcggggggcttggcacagccaggcggtctctgagactctcctgtgtagtctcaggattcagtcttagtgattatcacttggcctgggtccgtcaggctccagggaaggggcttgagtggatcactttcgtcagaattgaaaacgttatggtggaagtaaagagtacgccgcgtctgtgaaggaagattcaccgtctcaagggatgactcaacagtgttggccattacaaatgagcacctgagacccgacgacacaggcggtctatttactgcgccaggcgatcctgggacgtcgatgcatttgatatttggggccaggggacaatggtcaccgtctcttcagcttcaccaaagggcccatcggtcttcctggcgccctgctccaggagcacctctgggggcacagcggccctggctgcctggtcaggactacttcctatatactgtctgagcgggctggcaaggcgcatag

SEQ ID NO: 792952 - DNA, 645 bp, Homo sapiens
  misc_feature: 61026.44.86.H09.1.pb.heavy.1.raw 61026
ctatgcgcctgccagcccgctcagacagtatataggaagtagtccttgaccaggcagcccaggccgctgtgcccagaggtgctcctggagccagggcgccagggggaagaccgatgggcccttggtggaagctgaggagacagtgaccagggtgcaccgcccccatagattgaaagaccagtctccgctcgcaccagaaataaacggccgtgtcgccgcggcgtcacggaggtcagtttcagggagaagcggttcatgacgtgtccctcgaaatggtgagacgactcttgaggacggagagtagtacgtcgccccagtataatggatgtcaccaatccactccattccctccctgggggctgccggatccagccccaagaatgatcagaactgatggaaactccagaacagtgcagatgagagacagggttcccgaaggcctcaccagtcctgggccgactcctgcagctgcacctgggacaggacccatctgggagctgccacagccaggaggaaaaaccacagggtccatgttcttgcacaggagtccttgactctcagaaagcatccccaaacccaagtctatagcactaaatcgagcaccggtcgtgtatatactgtctgatggcgcgaggaggcgatacg

SEQ ID NO: 792953 - DNA, 670 bp, Homo sapiens
  misc_feature: 61053.UNK.UNK.UNK.pb.heavy.1.raw 61053
ctatgcgccttgccagcccgctcagacagtatataggaagtagtccttgaccaggcagccaggccgctgtgctctcgaggtgctcctggagcagggcgccaggggaagaccgatgggccttggtggaggctgagggacggtgacaggttcctggcccagtgacagttcctgatataaacacaacacaataatacatgccgtgtcctcggttttcaggttagtcattcgcagaatcaatgagttcttgaagtcatctcttgagaggtgaatctggctttcacagacgcggcgtactctgtgataaagctggcaactttgttttactgcggcaagccactccagccccttcctggagcctggcggaccagtcatatagtggtcactgatggtgaatccagaggcgacacaggagagtctcaggaccctccaggctggaccaagtctcccgactccacactgcacttcactctggacaccttgtaaaataacaacaggaaaccagctcagcccgaactccatggtgagtcctctgtgttcagtgctgatcacaaatgaaaacacctggaattctgggctgggctccgctctcagagctcccagagagatcgtgacgcagctaaatcgagcaccgtcgtgatagtatagactgatggcgcgaggaggcgatacg

SEQ ID NO: 792954 - DNA, 683 bp, Homo sapiens
  misc_feature: 61080.44.71.G05.1.pb.heavy.1.raw 61080
cgtatcgcctccctcgcgccatcagacagtatatacacgaccggtgctcgattagtgtcgtcgcaagagagaggagccccagccgtgagattcccaggagttccacttggtgatcagcactgagcacagaccaccaaccatggagtttggctaatctgatttccttgtagtttttttagaaggtgtccagtgcgagggcgactggcggagtcggggggggcttggcacagccagggcggctctgagactctcctgtgtagtctcaggattcagtcttagtgattatcacttggcctgggtccgtcaggctccaggaagggcttgagtggatcacttcgtcagaatgaaacgttatggtggaagtaaagagtacgccgcgtctgtgaagggaagattcaccgtctcaagggatgactccaacagtggttggccatttacaaatgagcaacctgagacccgacgacacaggcgtctattactgcgccaggcgatcctgggaccgtcgatgcatttgatatttggggccaggggacaatggtcaccgtctcttcagcttccaccaagggcccatcgtcttcccctggcgccctgcccaggagcacctctggggcacagcggccctgggctgcctggtcaagactacttctccttatactgtctgagcgggctggcaaggcgcatag

SEQ ID NO: 792955 - DNA, 651 bp, Homo sapiens
  misc_feature: 61081.UNK.UNK.UNK.pb.heavy.1.raw 61081
ctatgcgccttgccagcccgctcagacagtatataggaagtagtccttgaccaggcagccaggggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggaacgtgtccctcgaaatggtgagacgactcttgagggacggagagtagtacgtcgccccagtataatggatgtcaccaatccactccattcccctccctgggggctgcggatccagccccaagaatgatcagaactgatggaaactccagagacagtgcagatgagagacagggttcccgaaggcctcaccagtccctgggcccgactcctgcagctgcacctgggacaggacccatctgggagctgccccagcaggaggaaaaaccacaggtgcttcatgttcttgcacaggaggtccttgactctcagaaagcccccaatccctaatcacgtgtactaaatcgagcacggtcgtgtatatactgtctgatggcgcgagggaggcgatacg

SEQ ID NO: 792956 - DNA, 714 bp, Homo sapiens
  misc_feature: 61088.44.56.F01.1.pb.heavy.1.raw 61088
ctatgcgccttgccagcccgctcagacagtatataggaagtagtccttgaccagggcagcccagggccgctgtgccccagaggtgctcctggagcagggcgccagggggagaccgatgggcccttggtggaagctgaagagacgggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 792957 - DNA, 709 bp, Homo sapiens
  misc_feature: 61121.UNK.UNK.UNK.pb.heavy.1.raw 61121
ctatgcgccttgccagcccgctcagacagtaatataggaaagtagtccttgaccaggcagcccagggccgctgtgcccccagaggtgctcctggagcagggcgccagggggaagaaccgatggcccttggtggaagctgaagagacggtgaccattgtcccctggccccaaatatcaaatgcatcgacgtcccaggatcgcctggcgcagtaatagacgcctgtgtcgttcggggtctcaggttgctcatttgtaaatggccaacactgttggagtcatcccttgagacggtgaatcttcccttcacagacgcggcgtactctttacttccaccataacgtttcattctgacgaaagtgatccactcaagcccttccctggagcctgacggaccccaggccaagtgataatcactaagactgaatcctgaggactacacaggagagtctcagagaccgccctggctgtgccaagccccccccgactccgccagtccgccctcgcactggacaccttctaaaaaaaactacaaggaaaaatcaagattagcccaaactccatggttggtggtctgtgctcaagtgctgattccaccaagtggaaactcctgggaatctcacggctggggctcctctctcttgcgacgacactaaatcgagccaccggtcgtgtatatttactgtctgatggcggcgagggaggcgatacg

SEQ ID NO: 792958 - DNA, 703 bp, Homo sapiens; identical to SEQ ID NO: 792406
  misc_feature: 61127.44.55.E11.1.pb.heavy.1.raw 61127

SEQ ID NO: 792959 - DNA, 658 bp, Homo sapiens
  misc_feature: 61162.UNK.UNK.UNK.pb.heavy.1.raw 61162
cgtatcgcctcctcgcgccatcagaccgagtatataccacgaccggtgcttcgatttagtgctatagacttgggtttgggatgctttctgagagtcaaggacctctgtgcaagaacatgaagcacctgtggtttttcctcctgctggtggcagctcccagatgcggtcctgtcccaggtgcagctgcaggagtcggggccaggactggtgaggccttcgggaaccctgtctctcatctgcactgtctctggagtttccatcagttctgatcattcttgggggctggatccggcagcccccagggaggggaatggagtggattggtgacatccattatactggggcgacgtactactctccgtccctcaagagtcgtctcacatttcgagggacacgtccatgaaccgcttctccctgaaactgacctccgtgaccgccgcggacacggccccgtttatttctgtgcgaggcgagactggtctttcaatctatgggccgtggcacctggtcactgtctccctcagcttccacaagggcccatcggtcttcccctggccgccctgctccaggagcacctctgggggcacagcggccctgggctgcctggtcaaggactacttcctatatactgtctgagcgggctggcaaggcgcaatag

SEQ ID NO: 792960 - DNA, 614 bp, Homo sapiens
  misc_feature: 61163.44.27.C05.1.pb.heavy.1.raw 61163
ctatgcgccttgccagcccgctcagacagtatataggaagtagtccttgaccaggcagcccagggccgctgtgctctcggaggtgctctggagcagggcgccagggggaagaccgatgggcccttggtggaggccgaggagacggtgaccagggttccctggccccaggcgtcgaatgaaccgatttgggaaacagatagtctcgcacaaaatacacggccgtgtcctgaggtctcaggctgttcatttgaagagacactgtgttctcggaattgtctctggagatggtgaaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaacccttcgatcgcgtctaaatcgagcaccggtcgtgtatatactgtctgatggcgccgaggaggcgatacg

SEQ ID NO: 792961 - DNA, 592 bp, Homo sapiens
  misc_feature: 61172.UNK.UNK.UNK.pb.heavy.1.raw 61172
ctatgcgccttgccagccccgctcagacagtatataggaagtagtccttgaccaggcagcccagggccgctgtgctctcggaggtgctcctgggagcagggcgccagggggaaagaccgatgggcccttggtggagctgaggagacgggtgaccagggttccctggcccccaacagtcaaggccaggtggctggtggctctcgcacagaaatacacgggccgtgtcctcagatctcaggctgctcagttccatggtagactgtacctggggaggtgctcctggtcatactaactctgccttggaacttctgggcaaagcccgtgttgccactatagggcttcatccatccccatccactccagcccttgtccagcggcctgtcggcacccagttaatatcataattgatgaacgtgtatccagaagccgtgcaggagactgtcactgaggcccccaggcttctttcacctcagcagcgtggtgaccgtgaccctccagcaacttcgggcaaccccaaacccaaactactcacactaaatcgagcaccggtcggtgtatatactgtctgatggcgcgagggggaggcgatacg

SEQ ID NO: 792962 - DNA, 642 bp, Homo sapiens
  misc_feature: 61182.44.23.C01.1.pb.heavy.1.raw 61182
ctatgcgccttgccagcccgctcagacagtatataggaagtagtccttgaccaggcagcccagggccgctgtgcccccagaggtgctcctggagcagggcgccaggggaagaccgatgggcccttgtggaagctgaggagacagtgaccagggtgccacggcccatagattgaaagaccagtctcgcctcgcacagaaataaacggccgtgtccgcgcggtcacggaggtcagttcagggagaagcggttcatggacgtgtcctcgaaatggtgagacgactcttgaggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctggcccgactcctgcagctgcacctggacaggacccatctgggagctgccaccagcaggaggaaaaccacaggtgcttcatgttcttgcacaggaggtccttgactctcagaaagccccaatccctaatcacgtgtactaaatcgagcaccggtcgtgtatatactgtctgatggcgcgagggaggcgatacg

SEQ ID NO: 792963 - DNA, 625 bp, Homo sapiens
  misc_feature: 61189.UNK.UNK.UNK.pb.heavy.1.raw 61189
cccgacacgcttgctagggacttggagctaaggacgacatattgcctttagacagtcgaaggtgacgcccttagctaccactgaacgttttaggcgccagatgcccgggtctgggatgacctaatcgcagcttatcgatgatctactgcacgctcaaacccaaccaggtcttgatgcgcgcgataggactgacggatcgctacagacatttaactcgctagtaacttaattgagatcctaaggggatgggataggaaatagaatccacccctatcagcccccccacatagcctgcttggggtgtttgagtttacttttatttcgtgttggaatgagtttgaacttccgggaaagtggagtaaatgggtttgtctacttcccctaaaccgcaaaagtactagtttttacgagtggcgttgcaagccatagccagtcacaggtaataaacaattcaacgtgccgtaaagattggccgcttgctgtgggcattgcaaagctgggttttgcagcattgtgcatgctagacgacaatatgaatctgcgggacccctagtggcccaagatggccgctagcgggttccgcagcttttgacctggaccagggtgcatagcctgcccagccttc

SEQ ID NO: 792964 - DNA, 643 bp, Homo sapiens
  misc_feature: 61206.44.53.E09.1.pb.heavy.1.raw 61206
ctatgcgccttgccagcccgctcagacagtatataggaagtagtccttgaccaggcagccagggccgctgtgctctcggaggtgctcctggagcagggcgccaggggaagaccgatggcccttggtggaggctgaggatgaggagacggtgaccgtggtcccttggcccagacgtcccaagcgtggtagaattgagacgacctgccataggcggacccatgtctgacacagtagtagacagccgtgtcggcggcggccaccagaactcactttcagggaaaactgtgtcctcgacgtgtccacggatatggtgactcgaccgttgagggacgggttgtagtaggtgttcccactataatagagactcccaatcactgcagcccctctcctgggggctggcggatccagccccagtagaaattacttctgtcgatggaggcccagagaccgtgcacgtgaggacaggtctccgaaggcttcacagtctggcccgactcccgcagctgcggctgagacaggacccatctgggagccgccacagcaggaggaagaaccacaggtgcttcccccaacccaacacactctctctaaatcgagcaccggtcgtgtatatactgtctgatggcgcgagggaggcgatacg

SEQ ID NO: 792965 - DNA, 679 bp, Homo sapiens
  misc_feature: 61212.44.35.D02.1.pb.heavy.1.raw 61212
cgtatcgcctccctcgcgccatcagtctatactatcacgaccggtgctcgatttagcacacgatagttgggtttgggatactttctgagactcattgggcctcctgcacaagaacatgaaacacctgtggttcttcctcctcctgtggcacctcccagatgggtcgtgtccgaggtgcagctgcaggagtcgggcccagggacgggtgaagcctcggaccctgtccctcacctgcaaatgtctctggtggttacatcagtagttattattggagttggctgcggcagtccgccggggaaggactggagtggattggcgcatctataacagtggcagcaccaactacaaccccgccctcaagagtcgagtcaccatgtcacctagacaggtccaagaaccagttctccctgaaattgacttctgtgaccgccgcggacacggccgtatattattgtgcgagagattcctatcgatacagtagagacggggggggcgaactggctcgaccctggggccagggaaccctggtcaccgtctcctcagcctccacaagggcccatcggtcttcccccctggcaccctcctcccaagagcacctctgggggcacagcggccctgggctgcctgggtcaaggactacttcctatatactgtctgagcgggctggcaaggcgcatag

SEQ ID NO: 792966 - DNA, 587 bp, Homo sapiens
  misc_feature: 61216.44.78.H01.1.pb.heavy.1.raw 61216
cgtatcgcctccctcgcgccatccagaccagtatatacacgaccggtgctcgatttagtgtgagtagttgggtttggggggaagaggaagactgacggtcccactcccaggtacagctggtgcagtctggctgaggtgaagaagcctggcctccagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccaggaaccctggtcaccgtctcctcagcctcaccaagggccatcggtcttcccctggcgccctgctccaggagccacctccgagagcacagccgccctgggctgcctggtcaaggactacttcctatatactgtctgagcgggctggcaaggcgcatag

SEQ ID NO: 792967 - DNA, 661 bp, Homo sapiens
  misc_feature: 61253.44.86.H09.1.pb.heavy.1.raw 61253
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggcccaggactggtgaggccttcgggaaccctgtctctcatcgcactgtctctggagttttccatcagtttcttgatcattcttggggctggatccggcagccccagggaggggaatggagtggattggtgaccatccattatactggggcgacgtactactctccgtccctcaagagtcgtctcaccattcgagggacaacgttccatgaaccgcttctcccttgaaactgaccctccgtggccgccgcggacaccgcgccgtttatttctgtgcgaggcgagactggtctttcaatctatggggccggtggcaccctggtcacgtctcctcagcttccaccaagggcccatcggttcttcccccctggcgccctgctccaggagcacctctgggcacagcggccctgggctgcctggtcaaggactacttcctatatactgtctgagcgggctggcaaggcgcatag

SEQ ID NO: 792968 - DNA, 642 bp, Homo sapiens
  misc_feature: 61287.44.81.H04.1.pb.heavy.1.raw 61287
cgtatcgcctcctcgcgccatcagacagtatatacacgaccggtgctcgattttagtagtgtagattcgcggggctttctgagagtcatggacctcctggcaagaacatgaagcacctgtgttcttcctcctgctggtggcggctcccagatgggtcctgtccagctgcagctgcaggagtcgggcccagggatggtgaagccttcggagaccctgtccctcacctgcacgtctctggtggcttccatcagcagtagtagttactactgggctggatccgccagccccagggaagggctggagtggatgggagtatctattatagtggagcacctactacaacccgtccctcaagagtcgagtcaccatatcagtagacagtccaagaacagttctccctgaagctgagctctgtgaccgccgcggacacggccgtgtattactgtgcgagagtaggcagttcgtcaccaactactttgcactggggccagggaaccctggtcaccgtctcctcactccaccaagggcccatcggtcttcccctggcaccctcctcccaagagcacctctgggcacagcgccctggctgcctgtcaaggactacttcctatatactgtctgagcgggctggcaaggcgcatg

SEQ ID NO: 792969 - DNA, 573 bp, Homo sapiens
  misc_feature: 61289.44.78.H01.1.pb.heavy.1.raw 61289
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 792970 - DNA, 703 bp, Homo sapiens
  misc_feature: 61306.UNK.UNK.UNK.pb.heavy.1.raw 61306
ctatgcgccttgccagcccgctcagacagtatataggaagtagtccttgaccaggcagcccaggccgctggtgccccagaggtgctcttggaggggggtgccaggggaagacgatggcccttggtggaggctgaggagacggcgaccgtggtccttggcccaggcgtccatacattggagtagagcatgtcatatctgtatccacgagccccatctctcgcacagtagtagacagccgtgtctcgctctcaggctattcatttccagatatagtgtgttcttcgaattgtctctgagatggtgaatcggccttcacggaatctacataatatttattactccatcataccatataagtgccaccactccagtccttgcctggagcctggcggaccagtgcatgccatgtctgttgaaggtgaatccagacgctacacaggagagtctcagggacctccaggctggaccacgcctccccagactccaccagcttcacctgacactggacacctcttaaaagagcaacgagaaaacccaggtcagcccaaactccatggtgagtcctctgtgttcggtgctgatcaccgactggaaacaccgccgacttctggtgctgggctcctcccagagctcccaaaccacgagctcactctaaatcgagcatcgtgtatatactgtctgatggcgcgaggggggcgatacg

SEQ ID NO: 792971 - DNA, 696 bp, Homo sapiens
  misc_feature: 61347.UNK.UNK.UNK.pb.heavy.1.raw 61347
ctatgcgccttgccagcccgctcagacagtatataggaagtagtccttgaccaggcagcccaggccgctgtgctctcgaggtgctcctggagcagggcgccaggggaagaccgatgggcccttggtggaggctgaggagacggtgaccagggtttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggacaagtctccccggactccaccaactgcacttcactctggacaccttgtaaaataacaacaaggaaaacccagctcagcccgaactccatggtgagtcctctgtgttcagtgctgatcaccaatgaaaacacctgggaattctgggctgggcctccgctctcagagctcccaagagagatcgtgacgcagctaaatcgagcacggtcgtgtatatactgtctgatggcgcgaggaggcgatacg

SEQ ID NO: 792972 - DNA, 603 bp, Homo sapiens
  misc_feature: 61371.UNK.UNK.UNK.pb.heavy.1.raw 61371
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaaactagtactttgcggttagggaagtagacaaacccattactccacttcccggaagttcaactcattccaacacgaaataaagtaaactcaacaccccaagcaggctatgtgggggggtgataggggtggattctatttcctatcccatccctaggatctcaattaagttactagcgagttaaatgtctgtagcgatccgtcagtcctatcgcggcgcatcaagacctggttggtgagcgtgcagtagatcatcgataagctgcgagttaggtcatcccagaccgcatctgcgcctaaacgttcagtggtagctaaggcgtcaccttcgactgtctaaaggcaatatgtcgtccttagctccaagtccctagcaagcgtgtcgg

SEQ ID NO: 792973 - DNA, 687 bp, Homo sapiens
  misc_feature: 61388.44.55.E11.1.pb.heavy.1.raw 61388
ctatgcgccttgccagcccgctcagacagtatataggaagtagtccttgaccaggcagcccaggccgctgtgccccagaggtgctcttggaggagggtgccagggggaagaccgatgggcccttggtggaggcggaggcgacggtgaccagggttcctggccccagaagtcaacgaataataaccactccgagcgcgacttgtctcgcacagtaatagacgccgtgtcgtcgcctctcaggttgttcatttgaagataaaccgtgttcctgaattgtccctggagatggtgatcggccctcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtcaacaaggagaacccagctcagccaaactccatggtgagtctctgtgttcagtgctgatcaccgaatggaaacacctcggaatccagtgctgggctcctctccccaaacccaacgtgcgagtgctaaatcgagcaccggtcgtgtatatactgtctgatggcgcgaggaggcgatac

SEQ ID NO: 792974 - DNA, 654 bp, Homo sapiens
  misc_feature: 61398.UNK.UNK.UNK.pb.heavy.1.raw 61398
gtatcgcctcctcgcgccatcagacagtatataacgacggctgctcgattagtgagtcagtaaagggaaaggggctggagaggagcccagcctagaagtcggcggtgtttccattcgtgatcagcactgaacacagaggactcacatggagtttgggctggctgggtttcctcgttgctcttttaagaggtgtccagtgtcaggttcagctggtggagttcttgggaggcgtggtccagcctggacgtcctgaactctcctgtttgcgtccggactcagtttccggactctgccatgcactggggtccgccaggcctccaggcaaggggctggagtggtggcagtcatctgtctgatgaagtaaagaatactatggaaactccgtgaagggccgattctccgtctccagagacaatccaaacaccgtgatctacaattgacagagagccgagcccgctctctattatgtacgagcccatcgttctactggggccagggagccctggtcgcgcgtctctcagcctccaccagggcccatcgtcttccccctgcgccctggctcagagcacctccgagagcacagcggccctgggctgcctggtcaaggactactctcctatatactgtctgagcggcgctggcaaggcgcatgag

SEQ ID NO: 792975 - DNA, 641 bp, Homo sapiens
  misc_feature: 61400.44.19.B08.1.pb.heavy.1.raw 61400
cgtatcgctccctcgcgccatcagacagtatatacacgaccggtgctcgatttagtgagtcagtaagggggactcctgtgccccaccatggacacactttgctccacgctctgctgctgaccatcccttcaatgggggcctgtcccagatcaccgtgaaagagtctggcccctacattgtgaaacccacacagacgccctcacgctggacctgcacgtctcaggcttctcactcgtcactctggagagggcgttgtcttgggtgcggcagccccggaaaggcctggagtggatcgcactcacttattggaatgacgatatacgatatagtccttctctgacgaccagactcaccgctcacgaaggacacgtccaaaaaccaggtggtccttacattgaccaacgtggacctgtggacacaggcactatttctgtgcccacttcatgaccacaatgaccacgggcttcttcgaaccctggggccagggaatccaggtcaccgtctcatcagcctccaccaaggccatcggtcttccccctgcgccctgctccaggagcaccttccgagagcacagcggccctgggctgcctggtcaaggactacttcctatatactgtctgagcgggctggcaagggcatag

SEQ ID NO: 792976 - DNA, 741 bp, Homo sapiens
  misc_feature: 61403.44.85.H08.1.pb.heavy.1.raw 61403
ctatgcgccttggccagcccgctcagacagtatataggaagtagtccttgaccagggcagcccagggccgctgtggccccagaggtgctcttggaggagggtgccaggggaagaccgatgggcccttggtggaggctgaggagacgggtgaccgtggtcctgggccccagacggtccaaataccgtagtagtagtccccagcaggtggtagtactacaaatgtcctcgcaacagtaatacacagccgtgtcctcggcctctcaggctgttcatttgcagatacaggcgtgttctttggaattgtctctggagatggtgaatcggcccttcacggagtctgcatagtattttattacttccatcataccatataagtgccacccactccagccccttggcctggagcctggcggacccagtgcatgccataggtactgaaggtgaaatccagacgcctgcacaggagagtctcagggaccctcccaggctggaccacgcctcccccagacttccaccagctgcacctgacactggacacctcttaaaagagcaacgaggaaaaacccagctcagcccaaactccatggtgaggtcctctgtgttcagtgctgatcaccgaatgaaaaacaccgccgacttctagtgctgggctcctctcccagagctccccgcgactgagtgatactaaatcgagcaccggtcgtgtatatactgtctgattggcgcgagggaggcgatacg

SEQ ID NO: 792977 - DNA, 699 bp, Homo sapiens
  misc_feature: 61410.44.55.E11.1.pb.heavy.1.raw 61410
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtccgccaggctccaggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattatcgtttgacttctggggccagggaaccctggtcaccgtcgcctccgcctccaccaagggcccatcgtcttcccctggcaccctcctccaagagcacctctgggggcacagcggccctgggctgcctggtcaaggactacttcctatatactgtctgagcgggctggcaaggcgcatag

SEQ ID NO: 792978 - DNA, 647 bp, Homo sapiens
  misc_feature: 61418.44.12.B01.1.pb.heavy.1.raw 61418
ctatgcgccttgcagcccgctcagacagtatataggaagtagtcttgaccaggcagcccagggccgctgtgccccagaggtgctcttggaggaggtgccaggggagaccgatgggccctggtggaggctgaggagacggtgaccagggttccctggccccagtggtcaaagtagtggtgaacgactgccctactctcgcacagtaatacacggccgtgtccgcggcggtcacagagctcagcttcagggagaactggttcttgacgtgtctactgatatggtgaccgacttcttgagggacggttgtagtaggtgctcccactataatagatactcccaatccactccagccccttccctgggggctggcggatccagccccagtagtaactactactgtgatggagcacagagacagtgcagtgaggacagggtctccgaaggcttcaccagtcctgggcccgactctgcagctgcagctgggacaggaccccatctgggagccgccaccagcagaggaagaacacaggtgcttcatgttcttgcacaggaggtccatgactctcagaaagcccccgcggatctacactactaaatcgagcaccggtcgtgtatatactgtctgatggcgcgagggaggcgatacg

SEQ ID NO: 792979 - DNA, 609 bp, Homo sapiens
  misc_feature: 61421.44.23.C01.1.pb.heavy.1.raw 61421
cgtatcgcctccctcgcgccatcagaccagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcctttctccctgaaactgacctccgtgacgcgcggacacgccgtttatttctgtgcgaggcgagactggtctttcaatctatggggccgtggcaccctggtcactgtctcctcagctttccaccaagggcccatcggtcttccccctggcgccctgctccaggagcacctctggggggcacagcggccctgggctgcctggtcaaggactacttcctatatactgtctgagcgggctg

SEQ ID NO: 792980 - DNA, 674 bp, Homo sapiens
  misc_feature: 61435.UNK.UNK.UNK.pb.heavy.1.raw 61435
cgtatcgcctccctcgcgccatcagacagtatatacaacgaccggtgctcgatttagtagtgtagattcccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttccggagaccctgtccctcacctgcactgtctctggtggctccatcagcagtagtagttactactgggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgacccgccgcggacacggccgtgtattactgtgcgagagtagggcagttcgtcaccaactacttttgaccactggggccagggaacccctggtcaccgtctcctcagcctccaccaagggcccatcggtcttcccccctggcaccctcctccaagagcacctctgggggcacagcggccctgggctgcctggtcaaggactacttcctatatactgtctgagcgggctggcaagggcgcatag

SEQ ID NO: 792981 - DNA, 611 bp, Homo sapiens
  misc_feature: 61436.UNK.UNK.UNK.pb.heavy.1.raw 61436
ctatgcgccttgccagcccgctcagacagtatataggagtagtccttgaccaggcagcccagggccgctgtgcccccagaggtgctctggagcagggcgccagggggagaccgatgggcccttggtggaagctgaggagacagtgaccagggtgccacggccccatagatgaaagaccagtctcgcctcgcacagaaataaacggccgtgtccgcggcggtcacggaggtcagtttcagggagaagcggttcatggacgtgtccctcgaaatgggtgagacgactcttgagggacggagagtagtacgtcgccccagtataatggatgtcaccaatccactccattcccctccctggggctgccggatcagccccaagaatgatcagaactgatggaaactccagagacagtgcgatgagagacagggttcccgaaggcctcaccagtcctgggcccgactcctgcagctgcacctgggacaggacccatctgggagctgccccagcaggaggaaaaaccacaggtgttcaccctgcccaatcctaatcacgtgtactaaatcgagcaccgtcgtgtatatactgtctgatggcgcgagggaggcgatacg

SEQ ID NO: 792982 - DNA, 681 bp, Homo sapiens
  misc_feature: 61458.UNK.UNK.UNK.pb.heavy.1.raw 61458
ctatcgcgcttgcagcggcgctcagacagtatataggaagtagtccttgaccaggcagcccagggccgctgtgccccccagaggtgctcttgggaggaggtgccagggaagacgatggggcccttggtgaggctgaggagacggtgaccagggttccctggccccagtggtcaaagtagttggtgccgaactgccctactctcgcacacagtaatacacggccggtgtcgcgcggcggtcacagagctcagcttcaggggagaactggttcgttggagcgtgtctactgatatggtgactcgactcttggagggacgggttgtataggtgctcgccactataatagatactcccaatccactccagcccccttcctggggctggcggaccgagcgccccagtagtaactactactgctgatggaggccaccagagaccagtgcaggtgagggacagggtctcgaaggcttcaccagttcctggcggccgactcctgcagctgccagctgggacaggacccatctgggagccgccaccagcaggaggagagaaccacaggtgcttcatgttcttgcacaggagggtcatgactctcagaaagcccgcgccgcggaatctacactactaaatcgagcaccgtgtcggtatatactgtctgatggccgcgagggaggcgatacg

SEQ ID NO: 792983 - DNA, 604 bp, Homo sapiens
  misc_feature: 61468.UNK.UNK.UNK.pb.heavy.1.raw 61468
gaaggctgggcaggctatgcaccctgggtccaggtcaaaagctgcggaacccgctagcggccatcttggccactaggggtcccgcagattcatattgtcgtctagcatgcacaatgctgcaaacccagcttgcaatgcccacagcagcggccaatctttacgcacgttgaattgtttttacctgtgactggctatggcttgcaacgccactcgtaaaactagtactttgcggtagggaggggtagacaaacccattactcacttcccggaagttcaactcattccaacacgaataaaaagtaaactcaacaccccaagcaggctatgtgggggggggtgataggggtggattctatttcctatcccatcccctaggatctcaattaagttactagcgagttaaatgtctgtagcgatcccgtcagtcctatcgcgcgcatcaagacctggtggttgagcgtgcagtagatcatcgataagctgcgagttaggtcatcccagacgcatctggcgcctaaacgttcagtggtagctaaggcgtcaccttcgactgtctaaggcaatatgtcgtccttagctccaagtccctagcaagcgtgtcggg

SEQ ID NO: 792984 - DNA, 667 bp, Homo sapiens
  misc_feature: 61469.44.12.B01.1.pb.heavy.1.raw 61469
ctatgcggccttgccagcccgctcagacagtatataggaagtagtccttgaccaggcagcccagggccgctgtgccccagaggtgctcttggaggagggtgccaggggaagacgatgggccttggtggaggctgaggagacggtgaccagggttccctggccccagtggtcaaagtagttggtgacgaactgccctactctcgcacagtaatacacgcggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagcccagtagtaactactactgctgatggagccaccagagacagtgcaggtgagggacagggtctccgaaggcttcaccagtcctgggcccgactcctgccagctgcagctgggaacaggacccatctgggagccgccaccagcaggaggaagaaccacaggtgcttcatgttcttgcacaggaggtccatgactctcagaaagccccccgcggaatctacactactaaatcgagcaccggtcgtgtatatactgtctgatggcgcggagggaggcgatacg

SEQ ID NO: 792985 - DNA, 551 bp, Homo sapiens
  misc_feature: 61473.44.43.D10.1.pb.heavy.1.raw 61473
ctatgcgccttgccagcccgctcagacagtataataggaagtagtccttgaccaggcagcccaggccgctgtgcccccagaggtgctcctggagcagggcgccaggggaagaccgatgggcccttggtggaagctgaggagacggtgaccagggttccctggccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtggaaggtgtatccagaagccttgcaggagaccttcactgaggccccaggcttccttcacctcagccccttactgctagtctaaatcgagcaccggtcgtgtatatactgtctgatggcgcgagggaggcgatacg

SEQ ID NO: 792986 - DNA, 685 bp, Homo sapiens
  misc_feature: 61483.44.45.E01.1.pb.heavy.1.raw 61483
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggccccttcacggagtttccatagtatttctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 792987 - DNA, 689 bp, Homo sapiens
  misc_feature: 61489.UNK.UNK.UNK.pb.heavy.1.raw 61489
cgtatcgcctccctcgcgccatcagacagtatataccacgaccgtgctcgatttagctgcgtcacgatctcttgggagctctgagagcggagcccagcccagaattccaggtgttttcatttggtgatcagcactgacacagaggactccaccatggagttcgggctgaggctgggttttccttgttgttattttacaaggtgtccagagtgaagtgcagttggtggagtccggggagacttggtccagcctggagggtcctgagactctcctgtgtcgcctctggattcaccatcagtgaccactatatggactgggtccgccaggctccagggaaggggctgggagtgcttggccgcagtaaaaacaaagttgccagctttatcacagagtacgccgcgtctgtgaaagccagattcaccctctcaagagatgacttcagaactcattgattctgcgaatgactaacctgaaaacgaggacacggcgtgtattattgtgtgtggtttatatcagaactgtccactgggcagggaaccctgggtcacgtctctcagcctccacaagggccatcggtcttcccctgcggcgcctgctccaggagcactccgagagcacagcgccctggcctgcgcctggtcaagggactcgttcctatatactgtctgagcgggctggcaagggcatag

SEQ ID NO: 792988 - DNA, 704 bp, Homo sapiens
  misc_feature: 61492.44.27.C05.1.pb.heavy.1.raw 61492
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggtttttcctcgttgccctcttaagaggtgtcatgtgtcaggtgcaattcgtggagtctgggggaggcgtggccccagtaggggggtccctgagactctcctgtgcagcctctggattcaccttcgatattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaatgaacagcctgagacctcaggacacggccgtgtatttttgtgcgagactatctgtttccaaaatcggttcattcgacgccttggggccagggaccctggtcaccggtctcctcggcctccaccaagggcccatcggtcttcccccctggcgccctgctccaggagcacctccgagagcacagcggccctgggctgcctggtcaaggactacttcctatatactgtctgagcgggctggcaggcgcatag

SEQ ID NO: 792989 - DNA, 702 bp, Homo sapiens
  misc_feature: 61499.UNK.UNK.UNK.pb.heavy.1.raw 61499
cgtatcgcctccctcgcgccatcagacagtatatacacgaccgtgctcgatttagctgcgtcacgatctctcttgggagctctgagagcggagcccagcccagaattcccaggtgttttcaatttggtgatcagcactgaacacagaggactcaccatggagttcgggctgagctgggttttccttgttgtttatttacaaggtgtccagagtgaagtgcagttggtggagtccgggggagacttggtccagcctggagggtcctgagactctcctgtgtcgcctctggattcaccatcagtgaccactatatggactgggtccgccaggctccagggaaggggctggagtggcttggccgcagtaaaaacaaagttgccagcttattacagagtacgccgcgtctgtgaaagccagattcaccctctcaaaagagatgacttcaagaactcattgatctgcgaatgactaacctgaaaaccgaggacacgggcatgtaattattgtgttgtgtttttatatcaggaaactgtccactggggccaggaaccctggtcaccgtctcctcagcctccaccaagggccatcggtcttccccctggcgcccgctccaggagcacctccgagagcacagcggccctgggctgcctggtcaaggactacttcctatatactgtctgagcgggctggcaaggcgcatag

SEQ ID NO: 792990 - DNA, 608 bp, Homo sapiens
  misc_feature: 61516.UNK.UNK.UNK.pb.heavy.1.raw 61516
cccgacacgcttgctagggacttggagctaagacgacatattgcctttagacacgtcgaaggtgacgccttagctacgcactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttattgagatcctaggggatgggataggaaatagaatcccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcggttccgcagcttttgacctggaccagggtgcatagcctgcccagccttc

SEQ ID NO: 792991 - DNA, 650 bp, Homo sapiens
  misc_feature: 61521.44.57.F02.1.pb.heavy.1.raw 61521
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatcggcagcccccagggagggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 792992 - DNA, 679 bp, Homo sapiens
  misc_feature: 61532.44.45.E01.1.pb.heavy.1.raw 61532
ctatgcgccttgccagcccgctcagacagtatataggaagtagtccttgaccaggcagcccaggccgctgtgctctcggagtgctcctggagcaggcgccaggggaagaccgatgggcccttgtggaggctgaggagacggttgaccagggctccctggccccagtagaacgatgggctcgtacaataatagagagccgagtcctcggctctcaaattgttcatttgtagatacacggtgttcttggaattgtctctggagacggagaatcggccctttcacggagtttccatagtattctttacttccatcagacagatgactgccacccactccagcccttgtctggagcctggcggacccagtgcatggcagagtcactgaaactgagtccggacgcaacacaggagagtctcaggacgtcccaggctggaccacgcctccccagactccaccagctgaacctgacactgggacacctcttaaaagagcaacgaggaaaaacccagctcagcccaaactccatggtgagtcctctgtgtttcagtgctgatcaccgaatggaaacacgcgccgacttctagtgctgggctcctctccagcccctttcccttactgactcactaaatcgagcaccggtcgtgtatatactgtctgatggcgcgagggaggcgatacg

SEQ ID NO: 792993 - DNA, 674 bp, Homo sapiens
  misc_feature: 61537.UNK.UNK.UNK.pb.heavy.1.raw 61537
cgtatcgcctccctcgcgccatcagacagtatatacacgaccggtgctcgatttgtgtgagtgtttgggtttggggagctctgggagaggagcccagccttgggattcccaggtgttttcattcagtgatcaggactgaacacagaggactcaccatggagtttgggctgagctggattttccttgctgctatttttaaaagggtgtccagtgtgagggtgcagttggtggggagtctggggagtttggtaaagcctggggagtcccttagactccctgtgcagcctctggattcactttcagtaacgcctggatgacctggggtccgccaggctccagggagggcgggggttgcccgtattaccaaagcgacggtggacgcagactacgctgcacccctgaaaggcagattcaccatctcaagagatgattcaaaagatacggtgtctctgcagatgaacagcctgaaccccgaggacacagccgtctattactgtctgggatggttcattcggccagggacccctggtcacggtctcctcagcctccaccagggcccatcggtcttccctggcgcctgctccaggagcactccgagagcacagcggccctgggctgcctggtcaaggactacttcctatatactgtcctgagcgggctggcagggcgcatag

SEQ ID NO: 792994 - DNA, 706 bp, Homo sapiens
  misc_feature: 61620.44.55.E11.1.pb.heavy.1.raw 61620
cgtatcgcctccctcggcgccatcagacagtatatacacgaccggtgctcgatttagcactcgcacgttgggttgggggggagaggagccagcactgggattccgagggtgtttccattcggtgatcagcactgaaccagaggactctgccatggagttttggcttgagctgggttcttccttgttggacttttaaaaaggtgtccagtgtgaggtatcggctgatggagtctggagaggcttagtccagcctggggggtcccagagactctcctgtgcagcctctgggctcaccagtcgcaactacatgagttgggtccgccaggctccagggaaggggctggagtggggtctcagtcattttactggtgatttcacatactacgcagactcccgtgaagggccgattcaccatctccagggacaattccaggacacggtttatcttcaatgaacaaacctgagggcgacgacacgccgtctattactgtgcgagacaagtcggcgctcggagtggttattattcgtttgacttctggggccagggaaccctgcgtcaccgtcgcctccgctccaccaagggccccatccgtcttcccctggcaccctctcctccaagagcacctctgggggcacagcggccctgggctgcctggtcaggactacttcctatatactggtctgagcgggctggcaaggcgcatag

SEQ ID NO: 792995 - DNA, 616 bp, Homo sapiens
  misc_feature: 61659.44.23.C01.1.pb.heavy.1.raw 61659
cgtatcgcctccctcgcgccatcagtctatactatcacgaccggtgctcgatttagtacacgtgattagggattggggcagggtgaacactgtggttttttcctcctgctggtggcagctcccagatgggtcctgtcccaggtgcagctgcagggagtcggcccaggcggtgaggccttcgggaaccctgtctctcatctgcactgtctctggagtttccatcagttctgatcattcttggggctggatccggcagcccccagggaggggaatggagtggattggtgacatccattatacggggcgacgtactactctcgtccctcaagagtcgtctcaccatttcgagggaacacgtccatgaaccgctctccctgaaactgacctcctgaccgccgcggacacggcgtttatttctgtgcgaggcgagactggtctttcaatctattgggcccgtggcaccctggtcactgtctccctcagcttccaccaagggcccatcggtcttccccctggcgccctgctccaggagcactctgggggcacagcggccctgggctgcctggtcaaggactacttcctatatactgtctgagcgggctggcaaggcgcatag

SEQ ID NO: 792996 - DNA, 593 bp, Homo sapiens
  misc_feature: 61660.UNK.UNK.UNK.pb.heavy.1.raw 61660
gaaggctggcaggctatgcaccctggtcaggtcaaaagctgcggaacccgctagcggccatctggcactaggggcccgcagattcatattgtcgtctagcatgcacaatgctgcaaacccagcttgcaatgcccacagcaagcggccaatctttacgccacgtgaattgttattacctgtgactggctatggcttgcaacgccactcgtaaaactagtactttgcggttaggggaagtagacaaacccattacctcacttcccgaagttcaactcattccaacacgaaataaagtaactcaacacccccaagcaggctatgtgggggggtgataggggtggattctatttcctatcccatccctaggatctcaattaattctagcgagttaaatgtctgtagcgatcccgtccagtcctatcgcgcgcatcaagacctggttgtgagcggtgcagtagatcatcgataagctgcgagttaggtcatcccagaccgcatctggcgcctaaacgttcagtggtagctaaggcgtcaccttcgactgtctaaaggcaatatgtcgtcttagctccaagtccctagcaagcgttcgg

SEQ ID NO: 792997 - DNA, 609 bp, Homo sapiens
  misc_feature: 61664.44.36.D03.1.pb.heavy.1.raw 61664
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacggtaatgcggaaagaaacagctggtttctgtattataagtcttaccatctggacgtctggggcaaagggaccacggtcaccgtctcctcagcttccaccaagggcccatcggtcttccccctggcggcgcctgctccaggagcacctctggggggcacagcggccctgggctgcctggtcaaggactacttcctatatactgtctgagcgggctggcaaggcgcatag

SEQ ID NO: 792998 - DNA, 612 bp, Homo sapiens
  misc_feature: 61672.44.23.C01.1.pb.heavy.1.raw 61672
ctatgcgcctgccagcccgctcagacagatataggaaagtagtcttgaccaggcagcccagggcccgctgtgcccccagaggtgctcctggagcagggccgccaggggaagaccgaatggcccttggtggaagctgagagacagtgaccagggtgccaggcgcccatagattgaaagaccagtctcgcctcgcacagaaataaacggccgtgtccggcgcgtcacggaggtcagttttcaggagaagcggttcatggacgtgtccctcgaaatggtgagacgactcttgaggacggagagtagtacgtcgccccagtataatggatgtcaccaatccactcatcccctccctggggctgccggatccagccccaagatgatcagaactgatggaaactccagagacagtgcagatgagagacaggttcccgaaggcctcaccagtcctgggcccgactcctgcagctgcacctgggacaggacccatctggggagctgcaccagcaggaggaaaaaccacaggtgtttcaccctgccccaatccctaatcacgtgtactaaatcgagcaccggtcgtgtatatacgtctgatgccgcgagggaggcgatacg

SEQ ID NO: 792999 - DNA, 665 bp, Homo sapiens
  misc_feature: 61687.44.55.E11.1.pb.heavy.1.raw 61687
gtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgaggaggcgatacg

SEQ ID NO: 793000 - DNA, 662 bp, Homo sapiens
  misc_feature: 61703.44.38.D05.1.pb.heavy.1.raw 61703
cgtatcgcctccctcgcgccatcagacagtatatacacgaccggtgctcgatttagtatctgatagtgggtttgggggaagagaagactgacggtcctcccaggattcaggtgctgggcaccttgggcacggggaggtgtgtcacaagatttgggctctgggcaccgtgggcatgggggaggcttagttcagcctgggggtccctgagacttcctgtgcagcctctggattcaccttcagtagctactgatgcactgggtccgccaagctccagggaaggggctgtgtggggtctcacgtattaaagtgatggagtagcacaagctacgcgggactccgtgaaaggggccgatttcaccaatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacgtcaccgtctcctcagcttccaccaaggcccatccggtcttcccctggcgccctgctccagggcacctctgggggcacagcggccctgggctgcctggtcaaggactacttcctatatactgtctgagcggctggcaaggcgcatag

SEQ ID NO: 793001 - DNA, 692 bp, Homo sapiens
  misc_feature: 61708.UNK.UNK.UNK.pb.heavy.1.raw 61708
ctatgcgccttgccagcccgctcagacagtatataggaagtagtccttgaccaggcagcccagggccgctgtgccccagaggtgctcttggaggagggtgccagggggaagaccgatggcccttggtggaggcggagggacggtgaccagggttccctggcccagaagtcaaaacgaataataaccactcgagcgccgacttgtctcgcacagtaatagacgccgtgtcgtcgcctctcaggttgttcatttgaagataaacgtgttcctggaattgtccctggagatggtgaatcggcccttcacggagtctgcgtagtatgtgaaatcaccagtataaatgactgagaccactccagccccttccctggagctggcggaccaactcatgtagttgctgctgacggtgagcccagaggctgcacaggagagtctctggaccccccagctgactaagctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaccccacgtgcgagtgctaaatcgagcaccgtcgtgtatatactgtctgatggcgcgagggagggcgatacg

SEQ ID NO: 793002 - DNA, 682 bp, Homo sapiens
  misc_feature: 61717.44.73.G07.1.pb.heavy.1.raw 61717
gcgccttgccagccgctcagacagtatataggaagtagtccttgaccaggcagcccagggccgctgtgctctcggaggtgctcctggagcagggcgccagggggaagacgatgggccctggtggaggctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcatagtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctggctcgtctcccccctgagcgtagagctaaatcgagcaccggtcgtgtatatactgtctgatggccgcgaggaggcgatacg

SEQ ID NO: 793003 - DNA, 701 bp, Homo sapiens
  misc_feature: 61721.44.55.E11.1.pb.heavy.1.raw 61721
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaaacacctcggaatcccagtgctgggctcctctccccaaacccaacgtgcgagtgctaaatcgagcaccggtcgtgtatatactgtctgatggcgcgagggaggcgatacg

SEQ ID NO: 793004 - DNA, 682 bp, Homo sapiens
  misc_feature: 61727.UNK.UNK.UNK.pb.heavy.1.raw 61727
ctatgcgccttgccagcccgctcagacagtatataggaagtagtccttgaccaggcagcccagggccgctgtgccccccagaggtgctcctggagcagggcggccagggggaagaccggatgggccctttggtggaagctgaggagacagtgaccaggggtgccacggccccatagattgaaagaccagtcctcgcctcgcacagaaataaacggccgtgtccgccggcggtcacggaggtcagtttcagggagaagcggttcatggacgtgtcccctcgaaaatgggtgagacgactccttgagggacggagagtagtacgtcgccccagtataatggatgtcaccaatccactcccattcccccctccctgggggctgccggatccagcccccaaagaatgatcagaactgatggaaactccagagacagtgcagatgagagacaggggttcccggaaggcctcaccagtcctggggcccgactccctgcagctgcacctgggacaggacccatctgggagctgccaccagcaggaggaaaaaccacaggtgcttcatgttcttgcacagggaggtcttgactctcagaaaggcccccaatccctaatcacgtgtactaaatcgagcaccggttcgtgtatatactggtctgatggcgcccggaggggagggcgataccg

SEQ ID NO: 793005 - DNA, 619 bp, Homo sapiens
  misc_feature: 61741.44.23.C01.1.pb.heavy.1.raw 61741
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 793006 - DNA, 655 bp, Homo sapiens
  misc_feature: 61748.44.86.H09.1.pb.heavy.1.raw 61748
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccacctccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 793007 - DNA, 725 bp, Homo sapiens
  misc_feature: 61750.UNK.UNK.UNK.pb.heavy.1.raw 61750
cgtatcgccccctccctcgcgccatcagacagtatatacacgaccggtgctccggatttagatctactgacaaccacattcctcctctaaagaagcccctgggagcacagctcatcaccatggactggacgctggaggttcctctttgtggggtgggcaggcagcaacaggtttgtcccagtccctggtgcaactggtgcagtctgggactagaatggccgcaacctggtcctcgcgtgaccctttccctgcacggcctctggaagtacctaccagttccactacttataccatcaactgggtgcgccaggcccctggacaccaggggcttgagtggatgggtggaatcatccctctttttggctcactcacctacgcacgaaggacttccgggggcagaattacgattaccgcgggcggacaagtccacagacagcgcagtctccatgacaatgagttctttgaaatccgacgacacggccgtctactactgttgcgagaggtcccgtaacccccagcctcgcatggagcctttgagatctggggggcgggggggggggaaccctggtcattgtcacctcagcttccaccaaggggcccatcggtcttcccgccctggcgccctggctccaggagcacctctgggggcacagcagccccctgggctgccctggtcaaggactacttcctatatactgtctgagcggggctggcaaggcgcatag

SEQ ID NO: 793008 - DNA, 706 bp, Homo sapiens
  misc_feature: 61754.44.67.G01.1.pb.heavy.1.raw 61754
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaatatgtatactctaaatcgagcaccggtcgtgtatatactgtctgatggcgcgagggaggcgatacg

SEQ ID NO: 793009 - DNA, 681 bp, Homo sapiens
  misc_feature: 61759.44.71.G05.1.pb.heavy.1.raw 61759
cgtatcgcctcctcgcgccatcagacaggtataccacacgaccggtgctcgattagtgtcgtcgcaagagagaggagccccagcgtgagattcccaggagtttgccacttggtgatcagcactgagcacagaccacccaaccatggagtttgggctaatcttgatttccttgtagtttttttagaaggtgtccagtgcgagggcgactgcggagtcgggggggcttggcacagccgggcggtctctgagactctctgtgtagtctcaggattcagtcttagtgattatcacttggcctgggtccgtcaggctccagggaaggggcttgagtgatcactttcgtcagaatgaaacgttatggtggaagtaaagagtacgccgcgtctgtgaagggaagattcaccgtctcaaggatgactcaacagtgttggccatttacaaatgagcacctgagacccgacgacacaggcgtctattactgcgccaggcgatcctgggacgtcgatgcatttgatattggggccaggggacaatggtcaccgtctcttcagcttccaccaagggcccatcgtcttccccctggcgcctgcccaggagcacctcggggcacagcggccctggctgcctggtcaaggacttacttccgtatatactgttctgagcggctggcaaggcgcatag

SEQ ID NO: 793010 - DNA, 551 bp, Homo sapiens
  misc_feature: 61777.UNK.UNK.UNK.pb.heavy.1.raw 61777
ctatgcgccttgccagcccgctcagacagtatataggaagtagtccttgaccaggcagccagggccgctgtggcccccagagtgctcctggagcagggcgccagggggaagaccgatgggcccttggtggaagctgaggagacggtgaccgtggtccctttggccccagacgtccataccgtagtagtagtatgcaactccccgaactcccggcaccggctcttgcacagtaatacacagccgtgtcctcggctctcagactgttcattttgcagatacagcgtgttcttggcgttgtctctggagatggtgaatcggcccttcacggagtccgcgtagcttgtgctactccatcactattaatacgtgagacccacaccagccccttccctggcagcttggcggacccagtggcatcagtagctacctgaaggtgaatccagaggctgcacaggagatctcagggaccccacccaaacccaactacagatactaaatcgagcaccggtcgtgtatatactgtctgatggcccgcgagggaggcgataacg

SEQ ID NO: 793011 - DNA, 649 bp, Homo sapiens
  misc_feature: 61778.44.86.H09.1.pb.heavy.1.raw 61778
ctatgcgccttgccagccgctcagacagtatataggaagtagtccttgaccaggcagccagggcccgctgtgccccagaggtgctcctgagcagggccgccaggggaagaccgatgggccctttggtggaagctgagagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggagaaaaaccacaggtgcttcatgttcttgcacaggaggtccttgactctcagaaagcatccccaaacccaagtctatagcactaatcgagcaccggtcgtgtatatactgtctgatggcgcgagggaggcgatacg

SEQ ID NO: 793012 - DNA, 700 bp, Homo sapiens
  misc_feature: 61793.44.73.G07.1.pb.heavy.1.raw 61793
ctatgcgccttgccagcccgctcagacagtatataggaagtagtccttgaccaggcagcccagggccgctgtgctctcggaggtgctcctggagcagggcgccaggggaagacgatggccccttggtggaggctgaggagacggtgaccagtgtccctggccccagtgaaacgcccgataatagctgctgccacttccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccaccgcctcccccagactccaccaggtgcacctgacactggacacctcttaaaagagtaacgaggaaaaccagctcagcccaaactccatggtgagtcctctgtgttcagtgctgatcaccgaatggaaacaccgccgacttctagtgctgggctcctctcccagagctccctgagcgtagagctaaatcgagcaccggtcgtgtatatactgtctgatggcgcgagggaggcgatacg

SEQ ID NO: 793013 - DNA, 700 bp, Homo sapiens
  misc_feature: 61795.44.36.D03.1.pb.heavy.1.raw 61795
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcgcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaataacaacaaggaaaacccagctcagcccgaactccatggtgagtcctctgtgttcagtgctgatcaccaaatgaaaacacctgggaattctgggctggggcttcgctctcagagctccccaagagagatcgtgacgcagctaaatcgagcaccggtcgtgtatatactgtctgatggcgcgaggaggcgatacg

SEQ ID NO: 793014 - DNA, 698 bp, Homo sapiens
  misc_feature: 61814.UNK.UNK.UNK.pb.heavy.1.raw 61814
ctatgcgcttgccagccgctcagacagtatataggaaaagtccttgaccaggcaagcccagggccgctgtgctctcgaggtgctcctggagcagggcgccaggggaagaccgatgggccctggtggaggctgaggagacggtgaccagggttccctggccccagtggacagttcctgataaaacaccaacacaataataacatgcccgtgtcctcggttttcaggttagtcatcgcagaatcaatgatttcttgaagtcatctcttgagagggtgaatctggcttttcacagacgcggcgtacctgtgataagctggcaactttgttttactgcggccaagccactccagcccttccctggagcctggcggaccccgagttccatatagtggtcactgatggtgaatccagaggcgacacaggagagtctcagggacctccaggctggaccaagtctccccggacttccaccaactgcacttcactctggacaccttgtaaaataacaacaaggaaaaccagctcagcccgaactccatggtgagtcctctgtgtcatgctgatcaccaaatgaaaacacctgggaattctggggctgggctcccgctctcagagctccccaagagagatcgtgacgcagctaaatcgagcaccggtccgtgtatatactggtctgatggcgcgagggaggcgatacg

SEQ ID NO: 793015 - DNA, 713 bp, Homo sapiens
  misc_feature: 61825.44.56.F01.1.pb.heavy.1.raw 61825
ctatgcgcgccttgccagcccgctcagacagtatataggaagtagtccttgaccaggcagcccagggccgctgtgcccccagaggtgctcctggagcagggcgccagggggaagacgatgggcccttggtggaagctgaaaagagacgtgaccattgtccctggccccaaatatcaaatgcatcgacgtccccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagcccttccctggagcctgacggaccaggccaagtgataatcactaagactgaatcctgagactacacaggagagtctcagagaccgccctggctgtgccaagccccccccgactccgccagtcgccctcgcactggacaccttctaaaaaaactacaaggaaaatcaagattagcccaaactccatggttggtggtctgtgctcagtgctgatcaccaagtggaaaactcctgggaatctcacggctggggctcctctcccagagctcccctttgtgtgttcagacgtctgctaatcgagcaccggtcgtgtatatactgtctgatggcgcgagggaggcgatacg

SEQ ID NO: 793016 - DNA, 705 bp, Homo sapiens
  misc_feature: 61826.UNK.UNK.UNK.pb.heavy.1.raw 61826
ctatgcgccttgccagcccgctcagacagtatataggaagtagtccttgaccaggcagcccagggccgctgtgctctcggaggtgctcctggagcaggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagccaccggtcgtgtatatactgtctgatggcgcgagggaggcgatacg

SEQ ID NO: 793017 - DNA, 593 bp, Homo sapiens
  misc_feature: 61855.UNK.UNK.UNK.pb.heavy.1.raw 61855
cgtatcgcctccctcgcgccatcagacagtatatacacaccggtgctcgtttagtatctgatagctggttttcctgttgctatttaaaaggtgtccagtgtgagtgcagctggtgagtccgggaggcttagttcagcctggggtccctgagactcctgtgcagcctctggattcaccttcagtagctactggattgcactgggtccgccaagctccagggaaggggctggtgtgggtctcacgtattaatagtgatgggagtagcacaagctacgcggactccgtgaagggccgattcaccatctccaggacaacgcagaacacgctgatctgcaatgaacagtctgagagccgaggacacgctgtgtatactgtgcaagaccggtgcggagttcggggagttgcatactactactacggtatgacgtctgggccaagggccacggtcaccgtctcctcagcttccacaaagggcccatcggtcttcccctggcgccctgctccaggagcactctgggggcacagcggccctgggctgcctgtcaaggactacttcctatatactgtctgagcgggctggcaaggcgccatag

SEQ ID NO: 793018 - DNA, 692 bp, Homo sapiens
  misc_feature: 61875.UNK.UNK.UNK.pb.heavy.1.raw 61875
cgtatcgcctccctcgcgccatcagacagtatatacacgaccgtgctcgatttagctgcgtcacgatctctcttgggagctctgagagcggagccccagccccagaattcccaggtgttttcatttgtgatcagcactgaacacagaggactcaccatggagttcgggctgagctgggtttccttgtgttattttacaaggtgtccagagtgaagtgcagttggtggagtcgggggagacttggtccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcagagatgacttcaagaactcattgatctgcgaatgactaacctgaaaccgaggacacggcatgtattattgtgttgtgtttatatcaggaactgtccactggggccagggaaccctggtcaccgtctcctcagcctccaccaagggcccatcggtcttccccctggcgcctgctccagagcacctccgagagcacagcggccctgggctgcctggtcaaggactacttcctatatactgtctgagcgggctggcaaggcgcatag

SEQ ID NO: 793019 - DNA, 656 bp, Homo sapiens
  misc_feature: 61939.44.23.C01.1.pb.heavy.1.raw 61939
cgtatcgcctccctcgcgccatcagaacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcaagccccagggaggggaatggagtggattggtgacatccattatactggggcgacgtactactctccgtccctcaagagtcgtctcaccatttcgaggggacacgtccatgaaccgcttctccctgaaacctgacctccgtgaccgccgcggaccacgccgtttatttctgtgcgaggcgagactggtctttcaatcttatgggccgtggcaccctggtcactgtctcctcagcttccacccaagggcccatcggtcttccccctggcgccctgctccaggagcaccctctgggggcacagcggccctgggctgcctggtcaaggactacttcctatatactgtctgagcgggctggcaagcgcatag

SEQ ID NO: 793020 - DNA, 595 bp, Homo sapiens
  misc_feature: 61965.UNK.UNK.UNK.pb.heavy.1.raw 61965
agctgggcaggctatgcaccctggtccaggtcaaaagctgggaaaccccgctagcggcccatctttgccactaggggtcccgcagattcatattgtcgtctagcatgcacaatgctgcaaacccagcttgcaatgccacagcaagcgccaatctttacgccacgttgaattgtttattactgtgactggctatggcttgcaacgccactcgtaaaactagtactttgcggttagggggaagtagacaaacccattactccacttccggaagttcaacattccaacacgaaataaaagtaaactcaacacccaagcaggctatgtggggggtggatagggtgattctatttcctatcccatcccctaggatctcaattaagttactagcgagttaaaatgtctgtagcgatcccgtcagtctatcgcgcgcatcaagacctggtggttgagcgtgcagtagatcatcgataagctgcgagttaggtcatccagaccgcatctggcgcctaaaacgttcagtgtagctaaggcgtcacccttcgactgttaaaggcaatatgtcgtccttagctccaagtcctagcaagcgtgtcgg

SEQ ID NO: 793021 - DNA, 693 bp, Homo sapiens
  misc_feature: 61972.44.72.G06.1.pb.heavy.1.raw 61972
cgtatcgcctccctcgcgccatcagacagtatatacacgaccggtgctcgatttagctacgactgcaaggaaagggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggcttggtccagcctggggggtccctgagactctcctgtgcagcctctggattcacctttagtagttattggatgaactgggtccgcaggctccagggaaggggctggagtgggtggccatcatgaagaaagatggaactgagacacactatgtggactctgtgaagggccgattcaccatctccagagacaaacgccaagaactcactgtatctgcaaatgaaacagtctgagagtcgaggacacggctgtgtattattgtgcgggaggcgctgggtggctcattgactactgggttcagggaaccctggtcatcgtctcctcagcctccaccaagggccatcggtcttccccctggcgccctgctccaggagcacctccgagagcacagcggccctgggctgcctggtcaaggactaactttcctatatactgtctgagcgggctggcaaggcgcatag

SEQ ID NO: 793022 - DNA, 674 bp, Homo sapiens
  misc_feature: 62006.44.12.B01.1.pb.heavy.1.raw 62006
ctatgcgccttgccagcccgctcagacagtatataggaagtagtccttgaccaggcagcccaggccgctgtgcccccagaggtgctcttggaggagggtgccagggggaagaccgatgggcccttgtggaggctgaggagacggtgaccagggtttccctggccccagtggtcaaagtagttggtgacgaaactgccctactctcgcacagtaataccacgggccgtgtcgcggcggtcacagagctcagcttccagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagttcctgggcgccgactcctgcagctgcagctggacaggacccatctgggagccgccaccagcaggaggaagaaaccacaggtgcttcatgctgtcttgcacaggaggtccatgactctcagaaagccccccgccggaatctacactactaaatcgagcaccggtcgtggtatatactgtctgatgcgccgagggaggcgatacg

SEQ ID NO: 793023 - DNA, 729 bp, Homo sapiens
  misc_feature: 62009.UNK.UNK.UNK.pb.heavy.1.raw 62009
cgtatcgcctccctccgcgccatcagacagtatatacacgaccggtgctcgatttagcactcgccacgttgggttttggggagagggagcccagcactgggattccgaggtgttttccattcggtgatcagcactgaacaccagaggactcaccatggagttttggctgagctgggttctccttgttggacttttaaaaaggtgtccagtgtgaggtgcggctgatggagtctggaggaggcttagtccagcctgggggggtcccagaggactctccctgtgcagcctctgggcttcaccgtcagcagcaactacatgagttgggtcccgccaggctccagggaaggggctggagtgggtctcagtcatttatactgggtgatttcacatacttacgcagactccgtgaagggccgattcaccatctcccagggacaattcccaggaacacggtttatcttcaaatgaaacaacctgagaggcgacggacacggccgtctattactgtgcgagacaagtcggcgctcggagtggttatttattcgtttggacttctggggccaggggaaccctggtcaccgttcgcctccgcctccaccaagggccccatcggtcttccccctggcaccctcctccaagagcacctctgggggcacagcggccctgggctgcctggtcaagggactactttcctatatactgtctgaagcgggctggcaaggcgcatag

SEQ ID NO: 793024 - DNA, 695 bp, Homo sapiens
  misc_feature: 62013.UNK.UNK.UNK.pb.heavy.1.raw 62013
cgtatcgctccctcgcgccatcagacagtatatacacgacggtgctcgattagcagacgtctgaacacacaaaggggagctctgggagaggagcccagcgtgagattccaggagtttccacttggtgatcagcactgagcacagaccaccaccatggagtttgggctaatcttgattttccttgtagtttttttagaaggtgtccagtgcgaggggcgactggcggagtcggggggggcttgcacagccaggggcggtctctgagactctctgtgtagtctcaggattcagtcttagtgattatcacttggcctgggtccgtcagctccagggaaggggcttgagtggatcactttcgtcagaaatgaaacgttatgtggaagtaaacgagtacgccgcgtctgtgaaggaagatcaccgtctcaagggatgactccaacagtgttggccatttacaaatgagcaacctgagacccgacgacacagcgtctattactgcgccaggcgatcctggacgtcgatgcatttgatatttgggccaggggacaatgggtcaccgtctcttcagcttccaccaagggcccatcggtcttcccctggcgccctgctccaggagcacctctgggcacagcgccctggctgcctggtcaaggactacttcctatatactgtctgagcggctggcaaggcgcata

SEQ ID NO: 793025 - DNA, 676 bp, Homo sapiens
  misc_feature: 62018.44.6.A06.1.pb.heavy.1.raw 62018
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaccctggtcattgtcacctcagcttccaccaagggcccatcggtcttccccctggcgccctgctccaggagcaacctctgggggcacagcggccctgggctgcctggtcaaggactacttcctatatactgtctgagcggggctggcaaggcgcatag

SEQ ID NO: 793026 - DNA, 698 bp, Homo sapiens
  misc_feature: 62024.44.55.E11.1.pb.heavy.1.raw 62024
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggcccccagaagtcaaacgaataataaccactccgagcgccgacttgtctcgcacagtaatagacggccgtgtcgtcgcctcttcaggttgttcattgaagataaaccgtgttcctggaattgtccctggagatggtgaatcggcccttcacggagtctgcgtagtatgtgaaatcaccagtataaatgactgagaccccactccagccccttccctggagcctggcggaccaactcatgtagttgctgctgacggtgagccagaggctgcacaggagagtctctgggacccccaggctggactaagctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctctctccccaaaccaacgtgcgagtgctaaatcgagcaccggtcgtgtatatactgtctgatggcgcgagggaggcgatacg

SEQ ID NO: 793027 - DNA, 729 bp, Homo sapiens
  misc_feature: 62033.44.33.C11.1.pb.heavy.1.raw 62033
cgtatcgcctccctcgcgccatcagacagtatatacacgaccggtgctcgatttagagtgagctcgttggtttggggagctctgggagaggagcccagcaccagaagtcggcggtgttttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 793028 - DNA, 711 bp, Homo sapiens
  misc_feature: 62035.44.27.C05.1.pb.heavy.1.raw 62035
cgtatcgcctccctcggcgccatcagacagtatatacacgaccggtgctcgatttagacgcgatcgaagggttttggggctgggagacgagcccagcactggaagtcgccggtgtttccactcggtgatcatcactgaacacagaggactcaccatggagtttggggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcagggtgtgtcatttcatggaggaaatcaagtctacggtgattccgttgagggccgattcaccatctccaagagacaattccgagaacacagtgtctcttcaaatgaacagcctgagacctcaggacaacggccgtgtatttttgtgcgagactatctgtttccaaaatcggttcattcgacgcctggggccagggaaccctggtcaccgtctcctcggcctccaccaaggggcccatcggtcttccccctggcgccctgctccaggagcacctccgagagcacagcggccctgggctgcctggtcaaggactacttcctatatactgtctgagcgggctggcaaggcgcatag

SEQ ID NO: 793029 - DNA, 747 bp, Homo sapiens
  misc_feature: 62040.UNK.UNK.UNK.pb.heavy.1.raw 62040
cgtatcgcctcccctcgcgccatcagaccagtatatacacgaccgtgctcgatttagctgcgtcacgatctctcttggggagctctgagagcggagcccccagccccagaattcccaggtgttttcatttggtgatcagcactgaacacacagaggactcaccatggagttcgggctgagctgggttttccttgttgttattttacaaggtgtccagagtggaagtgcagttggtggagtccgggggagacttgggtccagcctggagggtccctgagacctctcctgtgtcgcctgctggattcaccatcagtgacccactatactggactgggtccgccaggctccagggaaggggcctggagtggcttcgcccgcagtaaaaacaaagttgcgcagctttatcacagagtacgcggccgcgtctgtgaaagccagattcaccctgctccaagagatgacttcaagaactcatttgattctggcgaatgactaacctgaaaaccgaggacacggcatgtttattgtgttgtgtgttatatcaggagactgtccagctgggggccagggaacccctggtcaccgtctcctcagcctccaccaagggcccatcggtcttccccctgcggcgcccgctccagggagcaccctccgagaggcacaggcggcccctggctggctggcgctgcaaggactacctgccgtaatatatactgtctggagccggggctgggcaaggcggcatag

SEQ ID NO: 793030 - DNA, 722 bp, Homo sapiens
  misc_feature: 62046.UNK.UNK.UNK.pb.heavy.1.raw 62046
cgtatccgcctcctcgcgccattcaagaccagtatatacacggaccggtggctcgatttaggacgcgatcgaagggtttggggctgggagacgagcccagcactggaagtcgccggtgtttccactcggtgatcatcactgaacacagaggactcccaccatggagtttgggctgaagctgggtttttcctcgttgccctctttaagaggtgtcatgtggtcaggtgcaaattcgtggagtctggggggagggcgtggccccagtaggggggggtcctgagacttccctgtgcagccctctggattcaccttcgataattgggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactattctgtttccaaaatcggttcattcgacgcctgggcccagggaaccctggtcaccgtctcctcggccctccaccaagggccccatcggtcttcccctggcgccctgctccaggagccacctccgagagccacagcggcctgggctgcctggtcaaggactacttcctatatactgtctgagcgggctggcaaggcgctag

SEQ ID NO: 793031 - DNA, 607 bp, Homo sapiens
  misc_feature: 62080.UNK.UNK.UNK.pb.heavy.1.raw 62080
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793032 - DNA, 576 bp, Homo sapiens
  misc_feature: 62099.44.78.H01.1.pb.heavy.1.raw 62099
cgtatcgcctccctcgcgccatcagacagtataatacacgaccggtgctcgatttagtgtgagtagtttgggtttgggtgccgaagttgctggaggtcacggtcaccacgctgctgaggtgaagaagcctgggggcctcagtgacagtctcctgcacggcttctggatacacgttcatcaattatgatattaactgggtgcgcaggcccgctggacaaggctggagggatgggatggatgaagccctatagtggcaacacgggcttgcccagaagttccaaggcagagttagtatgaccaggagcacctccccaggtaccagtcgtctacatggaactgagcagcctgagatctgaggacacgcgcgttatttctgtgcgagagccaccagcacctggcttgacttgtggggccagggaacgcctggtcaccgtctcctcagcctccaccaacgggcccatcgtcttccccctggcgccctgctccaggagcacctccgagagcacagcggcctgggctgcctggtcaagactacttcctatatactggtgctgagcgggctggcaaggcgcatag

SEQ ID NO: 793033 - DNA, 649 bp, Homo sapiens
  misc_feature: 62106.44.86.H09.1.pb.heavy.1.raw 62106
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtgcagctcccagatgggtcctgtcccaggtgcagctgcaggagtcgggcccaggactggtgaggccttcgggaaccctgtctctcatctgcactgtctctggagttccatcagttctgatcattcttggggctggatccgcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttcccctggcgccctgctcaggagcacctctgggggcacagcggccctgggctggcctggtcaaggactacttcctatatactgtctgagcgggctggcaaggcgcatag

SEQ ID NO: 793034 - DNA, 724 bp, Homo sapiens
  misc_feature: 62112.44.33.C11.1.pb.heavy.1.raw 62112
cgtatcgcctccctcgcgccatcagacagtataatacacgaccggtgctcgatttagagtgagctcgttggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaaggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactcaatggtatggacgcctgggccaagggaccacggtcgccgtctcctcagcctccaccaagggcccatcggtctccccctggcaccctcctccaagagcacctctgggggcacagcggcctgggctgcctggtcaaggactacttcctatatactgtctgagcgggctggcaaggcgcatag

SEQ ID NO: 793035 - DNA, 688 bp, Homo sapiens
  misc_feature: 62114.44.27.C05.1.pb.heavy.1.raw 62114
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttcctcttcccccaaacccttcgatcgcgtctaaatcgagcaccggtcgtgtatatactgtctgatggcgcgagggaggcgatacg

SEQ ID NO: 793036 - DNA, 667 bp, Homo sapiens
  misc_feature: 62152.44.81.H04.1.pb.heavy.1.raw 62152
cggtatgcccgttccctcgcgcggccatcagacagtaatatacacgaccggtgctcgatttagtagtgtagattcgcggggggctttctgagagtcatggaccttcctggtgcaagaacatgaacgcacctgtgttcctcctgctgctggggcggctcccagatgggtctgtccagctgcagctgcaggagtcggggccaggactggtgaagccttcggagaccctgtccctcacctgcactgtctctggtggctccatcagcagtagtagttactactggggctggatcgccagccccccagggaagggcctggagtggattgggagtatctattataggtgggagcacctactacaaccgtcctcaagagtcgagtcacgccatatcagtagacacgtccaagaaccagttctccctgaagctgagctctgtgaccgccgcggacacggccgtgtattactgtgcgagaggtagggcagttcgtcaccactacttgacactgggcagggaacccctggtcaccgtctcctccagcccccacaaggcccatcggctttccctggcaccctcctcccaagagcacctctgggggggcacagcgccctgggcagcctggtcaaggactatcctatatactgtctgaggcgggctggcaaggcgcatcc

SEQ ID NO: 793037 - DNA, 623 bp, Homo sapiens
  misc_feature: 62160.44.23.C01.1.pb.heavy.1.raw 62160
ctatgcgccctttgccagcccgctcagcacagtatataggaagatagtccttgaccaggcagcccaggccgctgtgccccagaggtgctcctggagcagggcgccaggggaagaccgatggggcccttggtggaagctgaggagacagtgaccagggtgccacggccccatagattgaaagaccagtctcgcctcacacagaaataaacggccgtgtccgcggcggtcacggaggtcagttcagggagaagcggttcatggacgtgtccctcgaaatggtgagacgactcttgagggacggaggagtagtacgtcgcccccagtataatggatgtcaccaatccactccattcccctccctggggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggagggaaaaccacaggtgttcaccctgcccaatccctaatcacgtgtactaaatcgagcaccggtcgtgtatatactgtctgatggcgcgaggaggcgatacg

SEQ ID NO: 793038 - DNA, 665 bp, Homo sapiens
  misc_feature: 62173.UNK.UNK.UNK.pb.heavy.1.raw 62173
cgtatcgcctccctcgcgccatcagacagtatatacagacggtgctcgatttagtgagtcagtaaggaaaggggctgggagaggagcccagcactagaagtcgcggtgtttccattcgtgatcacactgacacagaggactcaccatggagtttgggctgagctgggttttcctcgttgctctttaagagtgtccagtgtcaggttcagctggtggagtctggggaggcgtggtccagcctgggacgtcctgagactctctgtgtgcgtccgactcagtttcagtgactctgccatgcactgggtccgccaggctccaggcaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagccatcgttctactggggccagggagccctggtcaccgtctcctcagctccaccaagggcccatcggtcttccccctggcgcctgctcaggagcacctccgagagcacagcggcccctgggctgcctggtcaaggactacttcctatatactgtctgagcgggctggcaaggcgcatag

SEQ ID NO: 793039 - DNA, 640 bp, Homo sapiens
  misc_feature: 62196.UNK.UNK.UNK.pb.heavy.1.raw 62196
cgtatcgccctcctcgcgccatcagacagttatacacgaccggtgctcgatttagaagagtgtgttggtttgggggaagcacctgtggttcttcctcctgctgtggcggctcccagatgggtcctgtctcagccgcagcctgcggagtcgggcccagactggtgaagcctttcggagaccctgtcctcacgtgcacggtctctggtgcctccatcgacagagtaattctactggggctggatccgccagcccccagggagaggggctgcagtggattgggagtctctattatagtgggaacacctactacaacccgtcctcaacggtcgagtcaccatatccgtggacacgtcgaggacacagttttccctgaaagtgagttctgtggccgccgccgacacggctgtcttactactgtgtcagacatggtccgcctatggcaggctcaattctactcacgcttggacgtctggggccagggaccaacggtcaccgtctcctcatcctcagcctccaccaagggcccatcgtcttccccctggcgccctgccccagagcctcggagcacacagcggccctgggctgcctggtcaaggactacttcctatatactgtactgagcgggtggcaaggcgcatag

SEQ ID NO: 793040 - DNA, 697 bp, Homo sapiens
  misc_feature: 62205.44.36.D03.1.pb.heavy.1.raw 62205
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagctgggttttccttgttgttattttacaaggtgtccagagtgaagtgcagtggtggagtccgggggagacttggtccagcctggagggtccctgagactctctgtgtcgcctctggattcaccatcagtgaccactatatggactggtccgcaggctccaggaaggggctggagtggcttggccgcagtaaaaacaaagttgccagctttatcacagagtacgccgcgtctgtgaaaagccagattcaccctctcaagagatgactttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcggcctgctccaggagcactccgagagcacagcggcctgggctgcctggtcaaggactacttcctatatactgtctgagcggctggcaaggcgcatag

SEQ ID NO: 793041 - DNA, 718 bp, Homo sapiens
  misc_feature: 62220.UNK.UNK.UNK.pb.heavy.1.raw 62220
cgtatcgcctccctcgcgccatcagacagtatatacacgacggtgctcgattagtatcactcagtcgggggagctctggaagaggagcccagcactagaagtcggcggtgtttccattcggtgattcagcactgaacacagaggacttcaccatggagtttgggctgagctggggtttcctcgttgctcttttaagaggtgtccagtgtcaggtgcagctggtggagtctgggggaggcgtggtccagcctgggaggtcctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgacagcctgagagccgaggacacggcttgtattactgtgcgaggacatattgtagtactaccacctgctgggactactactacggtatggacgtctggggccaagggaccacggtcaccgtctcctcgcctcccaaaggcccatcggtcttccccctggcaccctcctccaagagcacctctgggggcacagcggccctgggctgcctggtcaggactacttcctatatatactgtctgagcgggctggcaaaggcgcatag

SEQ ID NO: 793042 - DNA, 675 bp, Homo sapiens
  misc_feature: 62236.44.12.B01.1.pb.heavy.1.raw 62236
ctatgcgccttgccagccgctcagacagtatataggaagtagtccttgaccaggcagcccagggcgctgtgcccccagaggtgctcttggaggagggtgccagggggaagaccgatgggccttggtggaggctgaggagacggtgaccagggttccctggccccagtggtcaaagtagttgtgacgaactgcccctactctcgcacagtaatacacggccgtgtccgcggcggtcacagaggctcagcttcagggagaactggttcttggacgtgtctactgatatggtgactcgactcttgagggacgggttgtagtaggtgctcccactataatagatactcccaatccactccagccccttccctgggggctgcggatccagccccagtagtaactactactgctgatggagccaccagagacagtgcaggtgagggaagaaaggggtctccgaaggcttcaccagtcctgggcccgaactcctggcagctgcagctgggacaggacccatctggggaagccgccaccagccaggaggaagaaccacaggtggctccatgttcttgcacaggggaggtccatgactctcagaaagccccgcggaatctacactactaaaatcgagcaccggtcgtgtataatactgtctgatggcgcgagggaggcgatacg

SEQ ID NO: 793043 - DNA, 653 bp, Homo sapiens
  misc_feature: 62263.44.6.A06.1.pb.heavy.1.raw 62263
cgtatcgcctcctcgcgccatcagacgtatatacacgaccggtgctcgattagatctactgacaaccacattcctcctctaagaagccccctgggagcacagctcatcaccatggactggcctggaggttctcttgtggtggcagcagcaacaggtgtctcagtcctggtgcaactggtgcagtctggactatagaatgccgcaacctggtcctcggtgaccctttcctgcacggcctcggaagtactaccagtccactacttatccatcactgggtgcgcccaggcccctggacaagggcttgagtggatgggtggaatcatccctctttttggctcactcacctacgcacgagcttccggggcagaattacgattaccgcggacaagtccacagacacagtctccatgacaatgagttctttgaaatccgacgacacggccgtctactactggtgcgagaggtccgtaccccagctcgcatggagccttgagatctgtgggcagggaaccctggtcattgtcacctcagcttccaccaagggccatcgtcttcccctgcgccctgctccaggagcacctctgggggcacagcggccctggctgctggtcaaggactattcctatatactgtctgagcgggctggcaaggcg

SEQ ID NO: 793044 - DNA, 699 bp, Homo sapiens
  misc_feature: 62290.44.36.D03.1.pb.heavy.1.raw 62290
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggtttcagttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggaccagtccatatagtggtcactgatggtgaatccagaggcgacacaggagagtctcagggaccctccaggctggaccagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaatcgagcaccggtcgtgtatatactgtctgatggcgcgagggaggcgatacg

SEQ ID NO: 793045 - DNA, 697 bp, Homo sapiens
  misc_feature: 62296.44.36.D03.1.pb.heavy.1.raw 62296
ctatgcgccttgccagcccgctcagacagtatataggaagtagtccttgaccaggcagccagggccgctgtgctctcggaggtgctcctggagcagggcgccagggggaagaccgatggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgttttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctccccaagagagatcgtgacgcagctaaatcgagcaccggtcgtgtatatactgtctgatggcgcgagggaggcgatacg

SEQ ID NO: 793046 - DNA, 678 bp, Homo sapiens
  misc_feature: 62301.44.45.E01.1.pb.heavy.1.raw 62301
ctatgcgccttgccagcccgctcagacagtatataggaagtagtccttgaccaggcagccaggccgctgtggctctcggaggtgctcctggagcagggcgccagggggaagaccgatgggcccttggtggaggctgaggagacggtgaccagggctccctggcccagtagaacgatgggctcgtacaataatagagagccgagtcctcggctctcaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggacacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctggggctcctctcccagcccctttccttactgactcactaaatcgagcaccggtcgtgtatatactgtctgatggcgcgagggaggcgatacg

SEQ ID NO: 793047 - DNA, 719 bp, Homo sapiens
  misc_feature: 62306.44.85.H08.1.pb.heavy.1.raw 62306
ctatgcgccttgccagcccgctcagacagtatatggaagtagtccttgaccaggcagcccagggccgctgtgcccccagaggtgctcttggaggagggtgccagggggaagaccgatgggcccttggtggaggctgaggagacggtgacgtggtccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattactttccatcataccatataagtgccacccactccagccccttgcctggagcctggcggacccagtgcatgccataggtactgaaggtgaatccagacgctgcacaggagagtctcagggacctcccaggctggaccacgactcccccagactccaccagctgcacctgacactggacacctcttaaaagagcaacgaggaaaaccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgaggaggcgatacg

SEQ ID NO: 793048 - DNA, 657 bp, Homo sapiens
  misc_feature: 62322.44.86.H09.1.pb.heavy.1.raw 62322
ctatgcgccttgccagcccgctcagacagtatataggaagtagtccttgaccgggcagcccagggccgctgtgcccccagaggtgctcctggagcagggcgccagggggaagaccgatggggcccttggtggaagctgaggagacagtgaccagggtgccacggccccatagattgaaagaccagtctcgcctcgcacagaaataaacggccggtgtccgcggcggtcacggaggtcagtttcaggagaagcggttcatggacgtgtcctcgaaatggtgagacgactcttgagggacggagagtagtacgtcgccccagtataatggatgtcaccaatccactccattcccctccctgggggctgccggatccagcccccaagaatgatcagaactgatggaaactccagagacagtgcagatgagagacagggttcccgaaggcctcaccagtcctgggcgcccgactcctgcagctgcacctgggacaggacccatctgggagctgccaccagcaggaggaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 793049 - DNA, 687 bp, Homo sapiens
  misc_feature: 62341.44.27.C05.1.pb.heavy.1.raw 62341
cccgctcagacagtatataggaagtagtccttgaccaggcagcccagggccgctgtgctctcggaggtgctcctggagcagggcgccagggggaagaccgatgggcccttggtggaggccgaggagacggtgaccagggttccctgccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 793050 - DNA, 609 bp, Homo sapiens
  misc_feature: 62349.UNK.UNK.UNK.pb.heavy.1.raw 62349
gacccgacacgctggctagggacttggagctaaggacgacatattgcctttagacagtcgaaggtgacgccttagctaccactgaacgtttaggcgccagatgccggtctgggatgacctaactcgcagcttatcgatgatctactgcacgctcaaccaaccaggtcttgatggcgcgcgataggactgacgggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggcccaagatggccgctagcggttccgcagctttgacctggaccagggtgcatagcctgcccagccttc

SEQ ID NO: 793051 - DNA, 716 bp, Homo sapiens
  misc_feature: 62363.UNK.UNK.UNK.pb.heavy.1.raw 62363
ctaatgcgccttgccagcccgctcagacaggtatataggaagtagtcttgaccaggcagcccagggccgctgtgcccccagaggtgctcttggaggagggtgccaggggaagacgcgatgggccctggtggaggcggagcgacggtgaccagggttccctggccccagaagtcaaacgaataataaccactccgagcgccgacttgtctcgcacagtaatagacgggccgtgtcgtccgcctctcaggttgttcatttgaagataaaccggtgttcctggaattgtccctggagatggtgaatcggcccttcacggagtctgcgtagtatgtgaaatcaccagtataaatgactgagacccactccagccccttccctggagcctggcggacccactcatgtagcttgctgctgacgggtgagcccagaggctgcaccaggagagtctctgggaccccccaggcggactaagcctcctccagactccatcagcccgcacctcacactggacaccttttaaaagtccaacaaggagaacccagctcaggccaaaactccatggtggagtcctcctgtgttcagtgctgatcaccggaatggaaacaccggtcggaaatcccagtgcctgggctcctctccccaaccaacgtgcgagttgctaaatcgagcaccgggtcgtgtatatactgtctgatggcgccgagggaggcgatacg

SEQ ID NO: 793052 - DNA, 705 bp, Homo sapiens
  misc_feature: 62368.44.55.E11.1.pb.heavy.1.raw 62368
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccaggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793053 - DNA, 710 bp, Homo sapiens
  misc_feature: 62370.44.36.D03.1.pb.heavy.1.raw 62370
cgttatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctttgttgttattttacaaggtgtccagagtgaagtgcagttggtggagtccgggggagaacttggtccagcctggagggtccctgagactctcctgtgtcgcctctggattcaccatcagtgaccactatatggactgggtccgccaggctccagggaaggggctggaagtggcttggccgcagtaaaaacaaagttgccagctttatcacagagtacgccgcgtctgtgaaagccagattccaccctctcaagaggatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793054 - DNA, 746 bp, Homo sapiens
  misc_feature: 62395.UNK.UNK.UNK.pb.heavy.1.raw 62395
ctatgcgccttgccagcccgctcagacagtataataggaagtagtccttgaccaggccaggcccagggccgctgtgcccccagaggtgctcttggaggagggtgcccagcggggaaagacccgatgggccccttggtggccaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgttgttcttcgaattgtctctggagatggtgaatcggccccttcacggaatctacataatatttattacttccatcataccatataagtgccacccactccagtcccttgcctggagcctggcggacccagtgcatgccatgtctgttgaaggtgaatccagacgctacacaggagagtctcagggacctccccaggctggaccacgcctcccagactccaccagcttcacctgacactggacacctcttaaaaagagcaacgagggaaaccccaggtcagcccaaactccatggtgagtcctctgtgttcggtgcttgatcaccgactggaaacaccgccgacttctggtgctgggctcctctccccagagctccccaaacccaaccgagctcactctaaatcgagcaacggtcgtggtatatactgtctgatggcgcgagggaggcgatacg

SEQ ID NO: 793055 - DNA, 668 bp, Homo sapiens
  misc_feature: 62397.44.53.E09.1.pb.heavy.1.raw 62397
cgtatcgcctccctcgcgccatcagacagtatatacacgaccggtgctcgatttagagagagtgtgttgggtttggggggaagcacctgtggttcttcctcctgctggtggcggctcccagatgggtcctgttcttcagccgcagctgcggagtcggcggcagactggtgaagccttcggagacctgtccctcacggttgcacggtctctggtgcctccatcgacagaagtaatttctactgggggctggatccgccagcccccagcgagaggggctgcagtggattggagtcttctattatagtgggaacacctactacaacccgtcccttcaacggtcgagtcaccatatccgtggacacgtcgcgggacacagttttccctgaaagtgagttctgtggccgcccgccgacacggctgttctactactgtgtcagacatgggttccgcctatggcaggtcgtctcaattctactacgcttgggacgttctggggccaagggcaccaaacgtcaccgtctcctcatcctcaggcctccaccaagggcccatcggtcttccccctggcgccctgctccaggagcacctccgagagcacagcgccctggctgcctggtcaaggactacttcctatatactgtctgagcgggggctggcaaggcgcatag

SEQ ID NO: 793056 - DNA, 706 bp, Homo sapiens
  misc_feature: 62433.UNK.UNK.UNK.pb.heavy.1.raw 62433
cgtatcgcctccctcgcgccatcagacagtatatacacgacggtgctcgatttagacgcgatcgaaggggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccagtaggggggtcctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagacacagtgtctcttcaaatgaacagcctgagaccctcaggacacggccgtgtatttttgtgcgagactatctgtttccaaaatcgtttcattcgacgcctggggccagggaccctggtcaccgtctcctcggcctccaccaagggcccatcggtcttccccctggcgccctgctccaggagcacctcgagagcacagcggccctgggctgcctggtcaaggactacttcctatatactgtctgaagcgggctggcaggcgcatag

SEQ ID NO: 793057 - DNA, 686 bp, Homo sapiens
  misc_feature: 62445.44.72.G06.1.pb.heavy.1.raw 62445
ctatgcgccttgccagccgctcagacagtatataggaagtagtccttgaccaggcagcccagggccgctgtgctctcggaggtgctcctggagcagggcgccagggggaagacgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggcccttcacagagtccacatagtgtgtctcagttccatctttcttcatgatggccacccactccagccccttccctggagcctggcggacccagttcatccaataactactaaaggtgaatccagagctgcacaggagagtctcagggaccccccaggctggaccaagcctccccagactccaccagttgcacctcacactggacaccttctaaaatagcaacaaggaaaaccagctcagtcccaattccatggtgagtcctctgtgctcagtgctgatcaccaagtggaaaggcttggagtccagggctaaggctcctctctcccctttccttgcagtcgtagctaaatcgagcaccggtcgtgtatatactgtctgatggcgcgagggaggcgatacg

SEQ ID NO: 793058 - DNA, 548 bp, Homo sapiens
  misc_feature: 62489.44.43.D10.1.pb.heavy.1.raw 62489
cgtatcgcctcctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctgggccagggaaccctggtcaccgtctcctcagcttccaccaaagggcccatcggtcttccccctggcgccctgctccaggagcacctctgggggcacagcggcctgggctgcctggtcaaggactacttcctatatactgtctgagcgggctggcaaggcgcatag

SEQ ID NO: 793059 - DNA, 698 bp, Homo sapiens
  misc_feature: 62513.44.36.D03.1.pb.heavy.1.raw 62513
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccaggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcat

SEQ ID NO: 793060 - DNA, 645 bp, Homo sapiens
  misc_feature: 62533.44.23.C01.1.pb.heavy.1.raw 62533
ctatgcgccttgccagcccgctcagacagtatataggaagtagtcttgaccaggcagcccaggccgctgtgcccccagaggtgctcctggagcagggcgccagggggaagacgatgggcccttggtggagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcccccatccctaatcacgtgtactaaatcgagcaccggtcgtgtatatactgtctgatggcgcgagggaggcgatacg

SEQ ID NO: 793061 - DNA, 730 bp, Homo sapiens
  misc_feature: 62550.44.85.H08.1.pb.heavy.1.raw 62550
ctatgcgccttgccagccgctcagacagtatataggaagtagtccgtgtttgaccaggcagccccaggcggcgctgtgcccccagaggtgctcttggaagggtgccagggggaagacgatgggccctgtggaggctgaggagacggtgaccgtggtccttgggcccaggacgtccataccgtagtagtagtcccagcaggtggtagtactacaatatgtcctcgcacagtaatacacagcgcgtgtcctcggctctcaggctgttcatttgcagatacagcgtgttcttggaattgtctctggagatgtgaatcggccccttcacggagtctgcatagttttatttacttccatcataccatataaggtgcccacccactcagcccttgcctggagcctggcgacccagtgcatgccataggctactgaaggtgaatccagacgctgcacagagagtctcggggacctcccaggctggaccacgcctccgccccagactcacagctgcacctgacactggacacctcttaaaggaggcaacgagggaaaacccagctcagccccaaactccatggcggagtcctctgtgttcagtgctggatcaccgaatggaaacaccgccgacttctagtgctggctcctctccccccccgcgactgagtgatactaaatcgagcaccggtcgtggtatatactgtctgatcatgatgggcgcgcaggaggcgatacg

SEQ ID NO: 793062 - DNA, 707 bp, Homo sapiens
  misc_feature: 62561.44.62.F07.1.pb.heavy.1.raw 62561
ctatgcgccttgccagcccgctcagacgtatataggaagtagtccttgaccaggccagccagggccgctgtgctctcggaggtgctcctggagcagggcgccagggggaagaccgatgggcccttggtggaggctggaagagacggtcaccactgtccccggccccaagtactaaaggtgtcatgggggtcaccgtggtcctggctttcaaaccagtaatagacgcctgtgtctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccccagactccaacaactgcacttcacacaccgacaccctttaaaaagccacaagaaaaggcagctcagcccaaactccatggagacttcctctgttcggtcctggtcaccaaatgagacactgaaaatcccagggctgggctcctctctcagagctccccttctccctttatgcgactactaaatcgagcaccggtcgtgtatatactgtctgatggcgcgagggaggcgatacg

SEQ ID NO: 793063 - DNA, 591 bp, Homo sapiens
  misc_feature: 62563.UNK.UNK.UNK.pb.heavy.1.raw 62563
cgtatcgcctccctcgcgccatcagacagtatataacgacggaccggtgctcgattttagtgtggagtagtttgggtttggggtgccgaagttgctggaggtcacggtcaccacgctgctgaggtgaagaaagcctgggcctcagtgacagttctcctgcacggcttctggatacacgttcatcaattatgatattaactgggtgcgacaggccgctggacaagggctggagtggatgggatggatgaagccctatagtggcaacacgggctttgtccagaaagttccaaggcagagttagtatgaccaggagcacctccccaggtacagtctacatggaactgagcagcctgagatctgaggacacggccgtgtattttctgtgcgagagccaccccagcacctggcttgacttgtggggccagggaaccctggtcacccgtcttcctcagcctccaccaaggggcccatcggttcttccccctgggccccctgctccaggagccacctccgagagcacagcggccctgggcttgcctggtcaaggactacttcctatatactgtctgagcgggctggcaaggcgcatag

SEQ ID NO: 793064 - DNA, 701 bp, Homo sapiens
  misc_feature: 62564.44.36.D03.1.pb.heavy.1.raw 62564
ctatgcgccttgccagccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793065 - DNA, 571 bp, Homo sapiens
  misc_feature: 62586.44.37.D04.1.pb.heavy.1.raw 62586
tatcgccttgccagcccgctcagacagtatataggaagtagtccttgaccaggcagcccagggccgctgtgcccccagaggtgctcatggagcagggcgccagggggaagaccgatgggcccttggtggaagctgaggagacggtgaccgacgtccccctgcccagacatccatcaaatagtagtagtttatgattccccgaaccgtttccttggaggtcccctcgcacagtaataaacagacgtgtcgtcaactctcacgctgttcattttgcaaatacagcatattcttggaattgtctctggagatggtgaatcggcccttcacggagtctgagtaatacttctcacttccatcgtcggagatgactgccacccactccggccccttgcctggagcctggcggacccagtgcaaaccaaatctatcgaatgagaaacccagaggctacacaggagagtctcagggacctcccgggctggaccacgcctcccccaaaacccaacagtatgctactaaatcgagcaccggtcgtgtatatactgtctgatggcgcgagggaggcgatacg

SEQ ID NO: 793066 - DNA, 731 bp, Homo sapiens
  misc_feature: 62587.UNK.UNK.UNK.pb.heavy.1.raw 62587
cgtatcgcctcctctctgcggccatcagacagtatatactcacgacggtgctcgatttagcactcgcacgttgggtttgcgggggagaggagcccagcacatggggattccgaggtgttccatttcggtgattcagcagctgaacacagaggactatcacccatggagttttggctgagctgggttcttccttgttggactttaaaaggtgtccagtggtgaggtgcggctgatggagtcatctggaggaggcttagtccagcctggggggtcccagagactctcctgtgcagacctctgggctcacaccgtcagcgcaaacaactaatgagttggatcgccaggctccaggggaaggggctggagtgggtctcagtcatttatactggtgatttcacatactacgcagacctccgtgaagggccgattcaccatctccaggggacaattccaggaacacggtttatcttcaaatgaaacacctgagaggcgacgacacggccgtctattactgtgcgagacaagtcgcgctcggagtggttattattcgttttgacttctgggccagggaaccctgggtcaccgtcgcctccgcctccaccaagggcccatcgggtcttcccctggcaccctcctccaagagcacctctggggcacagcggccctgggctgcctggtcaaggactaactttcctatattactgtctgagcgggctggcaaaggcgcatag

SEQ ID NO: 793067 - DNA, 641 bp, Homo sapiens
  misc_feature: 62594.44.12.B01.1.pb.heavy.1.raw 62594
agacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagcccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 793068 - DNA, 660 bp, Homo sapiens
  misc_feature: 62597.UNK.UNK.UNK.pb.heavy.1.raw 62597
cgtatcgcctccctcgcgccatcagacagtatatacacgaccgggtgctcgatttagtacacgtgattagggattgggggctttctgagagtcaaggacctcctgtgcaaaacatgaagcacctgtggttttttcctcctgctggtgcagctcccagatgggtcctgtccaggtgcagctgcaggagtcgggcccaggactggtgaggccttcgggaacctgtctctcatctgcactgtctctggagtttccatcagttctgatcattcttgggggctggatccggcagccccccagggagggaatggagtggattggtggacatccattatactggggcgacgtactactcttccgtccctcaaagaggtcgtctcaccattttcgaggggacacgtccatgaaccgcttccccctgaaactgactccgtggacccgccgcggacacggcccgtttatttctgtgcgaggcgagactggtctttcaatctatggggccgtggcaccctggtcactgtctcctcagcttcacccaggcccatcggtccttcccctggcggccctgctccaggagcacctctggggcacagcggccctgggctgcctggtcaaggactacttcctatatactgtcttgagcgggctggcaagggcgcatag

SEQ ID NO: 793069 - DNA, 728 bp, Homo sapiens
  misc_feature: 62609.44.86.H09.1.pb.heavy.1.raw 62609
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 793070 - DNA, 723 bp, Homo sapiens
  misc_feature: 62614.UNK.UNK.UNK.pb.heavy.1.raw 62614
cgtatcgcctccctcgcgccatcagacagtatatacacgaccgtgctcgatttagtgctatagacttgggttggggagctctgggagaggagccagcaccagaagtcggcggtgtttccagtcggtgatcagcaccgaacacagaggactcaccatggagtttgggctgacctgggttttcctcgttgctctttaagaggtgtcccagtgtcaggtggaagctggtggagtctggggaggcgtggtccagcctgggagcgtccctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacattcgaagaacacactatatctggaaatgaatagcctgagagccgaggacacggctgtctactactgtgcgagagatggggctcgtggatacagatatgacatgctctactccaatggtatggacgcctgggccaagggaccacgtcgccgtctcctcagcctccaccaagggcccatcggtcttccccctggcacctcctccaagagcacctctgggggcacagcggcctgggctgcctggtcaaggactacttcctataatactgtctgagcgggctggcaaggcgcatag

SEQ ID NO: 793071 - DNA, 717 bp, Homo sapiens
  misc_feature: 62616.UNK.UNK.UNK.pb.heavy.1.raw 62616
ctatgcgccttgccagccgctcagacagtatataggaagtagtccttgaccaggcagcccaggccgctgtgccccagaggtgctcttggaggagggtgccagggggaagaccgatgggcccttggtgaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggccttcacggaatctacataatatttattacttccatcataccatataagtgccacccactccagtccttgcctggagcctggcggacccagtgcatgccatgtctgttgaaggtgaatccagacgctacacaggagagtctcagggacctcccagctggaccacgcctccccagactccaccagcttcacctgacactggacacctcttaaagagcaacgagaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccgtcgtgtatatactgtctgatggcgcgaggaggcgatacg

SEQ ID NO: 793072 - DNA, 673 bp, Homo sapiens
  misc_feature: 62625.44.6.A06.1.pb.heavy.1.raw 62625
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggccctggacaaggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793073 - DNA, 693 bp, Homo sapiens
  misc_feature: 62633.UNK.UNK.UNK.pb.heavy.1.raw 62633
ctatgcgccttgccagcccgctcagacagtatataggaagtagtcttgaccaggcagcccagggccgctgtgctctcggaggtgctcctggagcagggcgccagggggaagaccgatgggcccttggtggaggccgaggagacggtgaccaggttccctggccccaggcgtcgaatgaaccgattttggaaacagatagtctcgcacaaaaatacacggccgtgtcctgaggtctcaggctgttcatttgaagagacactgtgtttctcggaattgtctctggagatggtgaatcggccctcaacggaatcccgtagacttgatttcctccatgaaatgacaccctgccacccactccagccctcgcctggagcctggcggacccactgcatattccaattatcgaaggtgaatccagaggctgcacaggagagtctcagggacccccctactgggcacgcctccccagactccacgaattgcacctgacacatgacacctcttaagagggcaacgaggaaacccagctcagcgccaaactccatggtgagtcctctgtgttcagtgatgatcacgagtggaaacaccggcgacttccagtgctggctcgtctcccagccccaaacccttcgatcgcgtctaaatcgagcacgtcgtgtatatactgtctgatggcgcgagggaggcgatacg

SEQ ID NO: 793074 - DNA, 684 bp, Homo sapiens
  misc_feature: 62640.UNK.UNK.UNK.pb.heavy.1.raw 62640
ctatgcgccttgccagccgctcagacagtatataggaagtagtccttgaccaggcagcccaggccgctgtgcccccagaggtgctcttggaggagggtgccagggggaagaccgatggcccatggtggaggctgaggagacggtgaccagggttccctggccccagtggtcaagtagttggtgacgaactgccctactctcgcacagtaatacacggccgtggtcccgcggcggtcacagagctcagcttcagggagaactggttcttggacgtgtctactgatatggtgactcgactcttgagggacgggtttgtagtaggtgctcccactataatagatactcccaatccacttccagcccttccctggggggctgggcggatccagccccagtagtaactactactgctgatggaagcccaccagagacagtgcaggtgagggacagggtctccgaggcttcaccagtcctgggcccgactcctgcagctgcagctgggacaggacccatctgggagccgccaccaggcagaggaagaagaaccacaggtgctcatgttcttgcacaggaggtccatgactctcagaaaagcccccgcggaatctacactactaaatcgaagcaccggtcgtgtatatactgtctgatggcgcgagggaggcgatacgctgtcagtctctc

SEQ ID NO: 793075 - DNA, 697 bp, Homo sapiens
  misc_feature: 62647.44.36.D03.1.pb.heavy.1.raw 62647
cgtaatcgcctcctcgcgccatcagacagtatatacacgaccggtgctcgatttagctgcgtcacgatctctcttgggggagagtggagccccagccccagaattcccaggtgttttcatttggtgatcagcactgaacacagaggacttcaccatggagttcgggctgagctgggttttccttgttgttattttacaaggtgtccagagttgaagtgcagttggtggagtccgggggagacttggtccagcctggagggtccctgagactctcctgtgtcgcctctgattcaccatcagtgaccactatatggactgggtccgccaggctccagggaaggggctggagtgcttggccgcagtaaaaacaaagttgccagctttatcacagagtacgcgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaacccctggtcaccgtctcctcagcctccaccaagggcccatcggtcttccccctggcgcctgctccaggagcacctccgagagccacagcggccctgggctgcctggtcaaggactacttcctaataactgtctgagcgggctggcaggcgcatag

SEQ ID NO: 793076 - DNA, 651 bp, Homo sapiens
  misc_feature: 62659.UNK.UNK.UNK.pb.heavy.1.raw 62659
cgtatcgcctcctcgcggccatcagacagtatatacacgaccggtgctcgattaggagagagtgttttgggtttgggggaagcacgtgtggttcttcctcctgctggtggcgctcccagatgggtcctgtctcagccgcagctgcgggagtcccggccaggactggtgaaggcttcggagaccctgtcctcaccgtgccacggtctctggtgccgtcatcgacagaagtaatttctactggggctggatccgccagccccagggagaggggcctgcagtggatttgggagtcttattatagtggcgaacacctactacaacccgtccctcaacggtcgagtcacatatccgtggacacgtcgaggaccacagttttccctgaaagtgagttctgtggccgccgccgacaacgctggtctactactgtgtcaacatggtccgcctatggcaggtcgtctcaattctactacgcttgggacgtctgggccaaggaccacggtcaccgtctcctcatcctcagcctccaccaagggccatcggtcttccccctggcgccctgctccaggagcacctccgagagcacagcgccctgggctgcctggtcaaggactacttcctatatactgtctgagcgggctggcaagggcatag

SEQ ID NO: 793077 - DNA, 711 bp, Homo sapiens
  misc_feature: 62666.44.56.F01.1.pb.heavy.1.raw 62666
ctatgcgccttgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggtgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 793078 - DNA, 641 bp, Homo sapiens
  misc_feature: 62673.UNK.UNK.UNK.pb.heavy.1.raw 62673
ctatgcgccttgccagcccgctcagacagtatatagggaagtagtccttgaccaggcagcccaggggccggctgtggcccccagaggtgctcctggagcagggcgccagggggaagaccgatggcccctttggtggaagctgaggagacggtgaccgtggtccctttgcccccaagacgtccaagatggtaaagacttataatacagaaaaccagctgtttcttttccccgcattacccgtgcacagtaattatgtgcctgtgtccgccagggtcatgttggtcatactaaagacccacctgcctttttggaggtgtccttggagatggttaaacctgctctttcagagatgtactgtaggatttttcgtcattcgagaagatgtgtgcaaagccactcccagggcctttccctggggcctgacggatcccaggctcacacccattctaatatcgttgagagagaacccagagatgtgccaggttccagcgtgagggtctctgtgggttttcaccagcacaggaccagactccttcaggtgacctgggacaagacccaaagagagatccgtgacgccagctaaatcgagccaccggtcgtgtatattaactgccctgatgggcgcgaagggaggcgatacg

SEQ ID NO: 793079 - DNA, 705 bp, Homo sapiens
  misc_feature: 62679.44.55.E11.1.pb.heavy.1.raw 62679
ctatgcgccttgccagcccgctcagacagtatataggaagtagtccttgaccaggcagcccagggccgctgtgcccccagaggtgctcttggagagggtgccagggggaagacgatgggcccttggtggaggcggaggcgacggtgaccaggggttccctggccccagaagtcaaacgaataataaccactccgagcgccgacttgtctcgcacagtaatagacggccgtgtcgtcgcctctcaggttgttcatttgaagataaaccgtgttccctggaattgtccctggagatggtgaatcggcccttcacggagtctgcgtagtatgtgaaatcaccagtataaatgactgagacccactccagcccctttccctggagcctggcggacccaactcatgtagtttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793080 - DNA, 727 bp, Homo sapiens
  misc_feature: 62683.44.33.C11.1.pb.heavy.1.raw 62683
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggcccaggcgtccataccattggagtagagcatgtcatatctgtatcacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgccctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtatatactgtctgatggcgcgaggaggcgatacg

SEQ ID NO: 793081 - DNA, 703 bp, Homo sapiens
  misc_feature: 62691.44.36.D03.1.pb.heavy.1.raw 62691
cgtatcgcctccctcgcgccatcagacagtatatacacgaccggtgctcgatttagctgcgtcacgatctctcttgggagctctgagagcggagccccagccccagaattccaggtgttttcatttggtgatcagcactgaacacagaggactcaccatggagttcgggctggagctgggtttttcccctgttgttattttacaaggtgtccagagtgaagtgcagtggtggagtccgggggagacttggtccagcctggagggtccctgagactctcctgtgtcgcctctggattcaccatcagtgaccactatatggactggtccgccaggctccagggaaggggctggagtggcttggccgcagtaaaaacaaagttgccagatttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaggcgcatag

SEQ ID NO: 793082 - DNA, 635 bp, Homo sapiens
  misc_feature: 62712.UNK.UNK.UNK.pb.heavy.1.raw 62712
ctatgcgcttgccagcccgctcagacagtatataggaagtagtccttgaccaggcagccagggccgctgtgcccccagaggtgctccctgagcaggcgccagggggaaggaccgatgggcccttggtggaagctgaggagacagtgaccaggtgccacggccccatagattgaaagaccagtctcgcctcgcacagaaataaacggcgtgtccgcgcgtcacggagtcagttcaggagaagcgttcatggacgtgtccctcgaaatggtgagacactcttgagggacggagagtagtacgtcgccccagtataatggatgtcaccaatccactccattccctccctgggggctgccggatccagccccaagaatgatcagaactgatggaaactccagagacagtgcagatgagagacagggttcccgaaggcctcaccagtcctgggcccgactcctgcagctgcacctgggacaggaccatctggagctgccaccagcaggaaaaaccacaggtgcttcatgttcttgcacaggagggtccttgactctcgaagcccccaatccctaatcagtgtactaaaatcgagcaccggtcgtgatagtatagactgatggcgcgagggaggcgatacg

SEQ ID NO: 793083 - DNA, 658 bp, Homo sapiens
  misc_feature: 62772.UNK.UNK.UNK.pb.heavy.1.raw 62772
ctatgcgccttgccagcccgctcagacagtatataggaagtagtccttgaccaggcaggcccaagggccgctgtgcccccagaggtgctcctggagcagggcgccagggggaagaccgatgggcccttggtggaagctgaggagacagtgaccagggtgccacggccccatagattgaaagaccagtcctcgcctcgcacagaataaacggccgtgtccgcggcggtcacggaggtcagtttcagggagaagcggttcatggaccgtgtccctcgaaatggtgagacgactcttgagggacggagagtagtacgtcgccccagtataatggatgtcaccaatccactccattccctccctgggggctgccggatccagcccaagaatgatcagaaactgatggaaactccagagacagtgcagatgagagaacagggttcccgaaggcctcaccagtctgggcccgactcctgcagctgcacctgggacaggacccatctgggagctgccaccagcaggaggaaaaaccacaggtgcttcatgtttcttgcacaggaggccttgactctcagaaaagccccccaatcctaatcacgtgtactaaatcgagcacggtcgtgtatatactgtctgatgggcgcgagggggaggcgatacg

SEQ ID NO: 793084 - DNA, 632 bp, Homo sapiens
  misc_feature: 62775.UNK.UNK.UNK.pb.heavy.1.raw 62775
agtataggaagtagtccttgaccaggcagccaggccgctgtgccccagaggtgtcctggagcaggcgccagggggaagaccgatgggccctggtgaagctgaggtgacaatgaccagggttcctgccccagatctcaaaggctcatgcagctggggtacggacctctcgcacagtagtagacggcgtgtcgtcggatttcaaagactcattgtcatgaggacgtggtctgtggacttgtcccggaatcgtaattctgcccggaagtctcggcgtaggtgagtgagccaaaagagggatgattccacccatccatcaagccctttccagggcctggcgcaccagttgatggtataagtagtggaactggtagtacttccagaggcgtgcaggaaagggtcaccgaggacaaggttgcggcattctagtcccgacgcccagttgcaccagggactggacacctgttgcgctgccaccacaaagaggaacctccaggtccagtccatggtgatgagctgtgctccagggctttctttagaggaggaatgtggttgttatgtgatgctcccctgatagagctactaaatcgagcaccggctgtatatactgctgatggcgcgagggaggcgatacg

SEQ ID NO: 793085 - DNA, 694 bp, Homo sapiens
  misc_feature: 62782.UNK.UNK.UNK.pb.heavy.1.raw 62782
cgtatcgcctcctcgcgccatcagacagtatatacacgaccgtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaaggtgtcatgtgtcaggtgcaattcgtggagtctgggggaggcgtggccccagtagggggtccctgagactctcctgtgcagcctctggattcaccttcgataattgaatatgcagtgggtccgccaggctccaggcgaggggctggagtgggtggcaggtgtgtcatttcatggagaaatcaagtctacggtgatccgttgagggccgattcaccatctccagagacaattccgagaacacagtgtctcttcaaatgaacagcctgagacctcaggacacggccgtgtatttttgtgcggactatctgtttccaaaatcggttcattcgacgcctggggccagggaaccctggtcaccgtctcctcggcctccaccaagggcccatcgtctccccctggcgccctgctccaggagcacctccgagagcacagcggcctgggctgcctggtcaaggactacttcctatatactgtctgagcggctggcaaggcgcatag

SEQ ID NO: 793086 - DNA, 631 bp, Homo sapiens
  misc_feature: 62800.44.86.H09.1.pb.heavy.1.raw 62800
ccttgccagcccgctcagacagtatataggaagtagtccttgaccaggcagcccagggccgctgtgccccagaggtgctcctggagcagggcgccagggggaagacgatgggcccttggtggaagctgaggagacagtgaccagggtgccacggcccatagattgaagaccagtctcgcctcgcacagaaataacggccgtgtccgcgggcggtcacggaggtcagtttcaggagaagcggttcatggacgtgtccctcgaaatggtgagacgactcttgaggacggagagtagtacgtcgccccagtataatggatgtcacaatccactccattcccctccctggggctgccggatccagccccaagaatgatcagaactgatggaaactcagagacagtgcagatgagagacagggttccgaaggcctcaccagtcctgggcccgactcctgcagctgcacctgggacaggaccatctggagctgcaccagcaggaggaaaaaccacagggcttcatgttcttgcacaggaggtccttgactctcagaaagcatcccaaacccaagtctatagcactaaatcgagcaccggtcgtgtatactgtctgatggcgcgagggaggcgatacg

SEQ ID NO: 793087 - DNA, 669 bp, Homo sapiens
  misc_feature: 62807.44.35.D02.1.pb.heavy.1.raw 62807
ctatgcgccttgccagccgctcagacagtatataggaagtagtccttgaccaggcagcccagggccgctgtgccccagaggtgctcttggaggagggtgccagggggaagaccgatggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactcagtcccttccggcggactgccgcagccaactccaataataactactgatgtaaccaccagagacattgcaggtgagggacagggtctccgaaggcttcacccgtcctggccgactcctgcagctgcacctcggacacgacccatctggaggtgccaccaggaggaggaagaaccacaggtgtttcatgttcttgtgcaggaggcccatgatctcagaaagtatcccaaacccaactatcgtgtgctaaatcgagcaccggtcgtgtatatactgtctgatggcgcgagggaggcgatacg

SEQ ID NO: 793088 - DNA, 683 bp, Homo sapiens
  misc_feature: 62808.UNK.UNK.UNK.pb.heavy.1.raw 62808
cgtatcgccccctcccgccatagacagtatataccgaccggtgctcgcgattagacgcgatcgaagggtttggcggggagacgagcccagccactggaatcccggtgtttcatcggtgatcatcactgaacacagaggactcaccatggagtttgggcgagctgggttttcctcgttgccctcttaagaggtgtcatgtgtcaggtgcattcgtggagtctgggagcgtggccccagtagggggtccctgagactctcctgtgcagctctgattcaccttcgataattggaatatgcagtgggcggccgcagctccagcgaggggctggatggtggcaggtgtgtcatttcatggaggaaatcaaagtctacggtgattccgtttgaggccgattcacatctccagagacaattccgagaacacagtgtctcttcaaatgaacagcctgagaacctcaggacacccggccgttattttgtgcgagactatctgtttccaaaatcggttcattcgacgcctggggcagggaaccctggtcaccgtctcctcggcctccaccaagggcccatcgtcttccccctggcgccctgctccaggagcactcggaagcacagcggccctgggctgccttggtcaaggactacttcctatatactgtctgagcgggctgcaaggcgcatag

SEQ ID NO: 793089 - DNA, 689 bp, Homo sapiens
  misc_feature: 62816.44.21.B10.1.pb.heavy.1.raw 62816
cgtatcgcctccctcgcgccatcagacagtatatacacgaccggtgctcgatttagtgtcgtcgcaagagagagccggagccccagccccagaattcccagtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccggaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793090 - DNA, 764 bp, Homo sapiens
  misc_feature: 62833.44.86.H09.1.pb.heavy.1.raw 62833
cgtatcgcctcccctcgcgccatcagacagtatgattacacgaccggtgctcgatttagtgctatagacttgggttggggagctctgggagaggaggccagcaccagaagtcggcggtgtttccagtccggtgatcagcacccgaaacacaggaggactcaccatggagtttgggctgacctgggtttttcctcgtttgctcttttaagagggttgtccagtggtcaggtgaaagctggtggagtctggggaggcgtggtccaagcctgggagggtccctgagactctccctgtgtagcgtctgattcaccttcaaacagacatggcatgcactcgggtccgccaggctccaggcaaggacggagtggcggggggggtggcacttatatggtatgatggaagtaataaatttatggtagatttcgtgaaggccgattcaccatctccagagacaattccgaagaacacacttatattctggaaatgaatagccttgagagcccgaggaacacgggctgtctactactgtgcgaagagatgggggctcgtggatacagataatgacatggctctactccaatggtgatggacgcctggggccaagggaccacggtcgccgtctcctcagccctccaccaagggcccatcggtctttcccctgcaaccctcctccagagcacctctggggcacagcggccctgggcaagcctggtcaaggactatttcctatatactgtctgagcggggctgccaaggcgcataga

SEQ ID NO: 793091 - DNA, 617 bp, Homo sapiens
  misc_feature: 62841.UNK.UNK.UNK.pb.heavy.1.raw 62841
cccgacacgcttgctagggacttggagctaaggacgacatattgcctttagacagtcgaaggtgacgccttagctaccactgaacgtttaggcgccagatgcggttctgggatgacctaactcgcagcttatcgatgatctactgcacgctcaaccaaccaggtcttgatgcgcgcgataggactgacggatcgctacagacatttaactcgctagtaacttaattgagatcctaggggatgggataggaaaatagaatccacccctatcaccccccccacatagcctgcttggggtgttgagtttttacttttatttcgtgttggaatgagttgaacttccgggaagtggagtaatgggttttgtctactttcccctaaccgcaaagtactagtttttacgagtggcgttgcaagccatagccagtcacaggtaataaacaattcaacgtggcgtaaagattggccgcttgctgtgggcattgcaagctggggtttgcagcattgtgcatgctagacgacaatatgaatctgcgggacccctagtggccaagatggcccgctagcgggttccgcagcttttgacctggaaccagggtgcatagcctgccagccttc

SEQ ID NO: 793092 - DNA, 623 bp, Homo sapiens
  misc_feature: 62849.UNK.UNK.UNK.pb.heavy.1.raw 62849
cgtatcgcctcctcgcgccatcagacagtatatacacgacgcggtgctcgatttagctgccgtcacgatctctttgggtctttgtcgccaggtcaccattgaaagtgagtctggtcctgtgcctgtgctgaaggaaacccacagagaccctcaccgctgacctgcaccatctctgggttctctctccaatcgatattagaatggtgtgagcgattgcgtcagccccgccagggaaggcctgagtggcttgcacacatcttctcgaatagacgaaataatcctacaagagtacatctcctgaagagcagagtttaaccatctccaaggaacctccaaaaggcaggtggtcttagttatgaccaacatgacctgcggacacaggcacatattacctgtgcacgggtaatgcggaaagaaacagctggctttctgtattataagtcttacatctggacgtctggggcaaagcggaccacgggtcaccgtctcctcagcttccacaagggccatcggtcttccccctggcgccctgctcaggagcactctggggcacagcggccctggctgcctggtcaaggactaacttcctatatactcgtctgagcggctggcaaggcgcatag

SEQ ID NO: 793093 - DNA, 620 bp, Homo sapiens
  misc_feature: 62850.44.23.C01.1.pb.heavy.1.raw 62850
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgagcgagactggtctttcaatctatggggccgtggcaccctggtcactgtctcctcagcttccaccaaggcccatcggtcttccccctggcgccctgctccaggagcacctctgggggcacagcggccctgggctgcctggtcaaggactacttcctatatactgtctgagcgggctggcaaggcgcatag

SEQ ID NO: 793094 - DNA, 607 bp, Homo sapiens
  misc_feature: 62885.UNK.UNK.UNK.pb.heavy.1.raw 62885
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggcccgctagcgggttccgcagcttttgacctggaccagggtgcatagcctgccccagccttc

SEQ ID NO: 793095 - DNA, 685 bp, Homo sapiens
  misc_feature: 62891.44.35.D02.1.pb.heavy.1.raw 62891
ctatgcggccttgccagcccgctcagacagtatatagaagtagtccttgaccaggcagcccagggccgctgtgcccccagaggtgctcttggaggaaggggtgccagggggaagaccgatgggcccttggtggaggctgaggagaacggtgaccagggttccctggccccaggggtcgagccaggtttcgccccccgtctctactgtatcgataggaatctcttcgcacaataatatacggccgtgtccgcggcggtcacagaagtcaatttcagggagaactggttcttggacctgtctagtgacatggtgactcgacctctgagggcggggttgtagttggtgctgccactgttatagatgcgcccaatccactccagtcccttcccggcggactgccgcagcaactcaataataactactgatgtaaccaccagagacattgcaggtgagggacaggggtctcccgaaggcttcacccgtcctgggcccgactcctgcagctgcacctcggaccacgacccatctgggaggtgccaccaggaggaggaagaaccacaggtgtttcatgttcttgtgcaggaggcccatgagtctcagaaagtatccccaaacccaactatcgtgtgctaaatcgagcaccggtcgtgtatatactgtctgatggcgcgagggaggcgatacg

SEQ ID NO: 793096 - DNA, 679 bp, Homo sapiens
  misc_feature: 62892.UNK.UNK.UNK.pb.heavy.1.raw 62892
ctatgcgccttgccagcccgctcagacagtatataggaagtagtccttgaccaggcagcccagggccgctgtgctctcggaggtgctcctggagcagggcgccaggggaagaccgatgggcccttggtgaggctgaggagacggtgaccagggctccctggccccagtagaacgatgggctcgtacaataatagagagccgagtcctcggctctcaaattgttcatttgtagatacacggtgttcttgaattgtctctggagacggagaatcggcccttcacggagtttccatagtattctttacttccatcagaccagatgactgccacccactccagcccttgcctggagcctggcggacccagtgcatggcagagtcactgaaactgagtcggacgcaacacaggaagtctcagggacgtcccaggctggaccacgcctccccccagactccaccagctgaacctgaccactggacacctctttaaaaagcaacgaggaaaaacccagctcagcccaaactccatggtgagtcctctgtgttcagtgctgatcaccgaatggaaacaccgccgacttctagtgctgggctcctctcccagcccctttccccttactgactcactaatcgagcacggtcgtgtatatactgtctgatggcgcgagggaggcgatacg

SEQ ID NO: 793097 - DNA, 619 bp, Homo sapiens
  misc_feature: 62898.UNK.UNK.UNK.pb.heavy.1.raw 62898
ctatgcgccttgccagcccgctcagacagtatatagagtaagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgccacctgggacaggacccatctgggagctgccaccagcaggaggaaaaaccacaggtgttcaccctgcccaatccctaatcacgtgtactaaatcgagcaccgtcgtgtatatactgtctgatggcgcgagggaggcgatacg

SEQ ID NO: 793098 - DNA, 722 bp, Homo sapiens
  misc_feature: 62899.UNK.UNK.UNK.pb.heavy.1.raw 62899
ctatgcgccttgccagcccgctcagacagtatataggaagtagtccttgaccaggccagcccagggcgctgtgcccccagaggtgctcttggaggagggtgccagggggaagaccgatgggccccttggtggaggctgaggagacggtgaccgtggtcccttggccccagacgtccataccgtagtagtagtcccagcaggtggtagtactacaatatgtcctcgcacagtaatacacagccgtgtcctcggctctcaggcgctgttcattgcagatacagcgtgttcttggaattgtctctggagatggtgaatcggcccttcacggagtctgcatagtatttattacttccatcatacccatataagtgccacccactccagccccttgcctggagcctggcggacccagtgcatgccataggtactgaaggtgaatccagacgctgcacaggagagtctcagggaacctcccaggctggacacgcctcccccagactccaccagctgcacctgacactggacacctcttaaaagaggcaacgaggaaaacccaggctcagcccaaactccatggtgagtcctctgtgttcagtgctgatcaccgaatggaaacaccgccgacttctagtgctgggctcctctcccccccgcgactgagtgatactaaaatcgagcaccgtcgtgtatatactgtctgatggcgcgagggaggcgatacg

SEQ ID NO: 793099 - DNA, 712 bp, Homo sapiens
  misc_feature: 62906.UNK.UNK.UNK.pb.heavy.1.raw 62906
ctatgcgccttgccagcccgctcagacagtatataggaagtagtccttgaccaggcagcccaggcccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggaccacctttttaaaagtccaacaaggagaacccagctcagccaaaactccatggtgagtcctctggtgttcagtgctgatcaccgaatggaaacacctcggaatcccagtgctgggctcctctcccccccaaacccaacgtgcgagtgctaaatcgagcaccgttccgtgtatatactggtctgatggcgcgaggggaggcgatacg

SEQ ID NO: 793100 - DNA, 703 bp, Homo sapiens
  misc_feature: 62913.44.55.E11.1.pb.heavy.1.raw 62913
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcgctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793101 - DNA, 609 bp, Homo sapiens
  misc_feature: 62922.44.36.D03.1.pb.heavy.1.raw 62922
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcaggggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 793102 - DNA, 745 bp, Homo sapiens
  misc_feature: 62923.UNK.UNK.UNK.pb.heavy.1.raw 62923
ctatgcgccttgccagcccgctcagaccagtaattataggaagtagtccttgaccaggcagcccagggccgctgtgcccccagaggtgctcttggaaggagggtgccaggggaaggaccgatgggcccttggggaggctgaggagacggtgaccggtggtcccttggccccagacgtccataccgtagtagtagtcccagcaggtgagtagtactaacaataatgtcctcgcacagtaatacacagccgtgtcctcggctctcaggctgtttcatttgcagatacagcgtgttcttggaaattgtctctggagatggtgaatcggcccttcacggagtctgcataagtatttattacttccatcataccatataagtgccacccactgccagccccttgcctggagcctggcggacccagtgcatgccataggtactgaaggtgaatccaggacgctgcacaggaggagtctcagggattcctcccaggctggaccacgcctccccccagactccaccagctgcacctgacactgggacacctcttaaaagagcaacgaggaaaaacccagctcagccccaaatctccatggtgagtcctctgtggttcagtgctgatcaaccgaatggaaaccaccgccgacttctagtgctgggcctcctctcccccccgcgactgaagtgattactaaaatcgagcaccggtcgtgtataatactgtctgatggcgcgagggaggcgatacg

SEQ ID NO: 793103 - DNA, 698 bp, Homo sapiens
  misc_feature: 62928.UNK.UNK.UNK.pb.heavy.1.raw 62928
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacggtgaccagggttccctggccccaggggtcgaaccaatttccatgtgtgggactatgagagggactatgaaagttgacgagggctctcgcacagaaatagatggccgtgtcttcagatctcagcctgctcagctccatgtaggctgtactcgtggattcgtccgcggtaatggtgactctgtcctgaaacttctgtggcgtaattcgatgccaccaaagatagggatgatccctcccagccactcaagcccttgtccaggggcctgtcgcacccaaataaaagcatagctgaagaaggtgcctccagaagccttgcaggagaccttcaccgaggacccaggcttcttcacctcagccccagactgccaccagctgcacctgggactggacacctgtagctgctgccaccacaaagaggaaaccgccaggtccagtccatggtgatgagctgtgctcccaggggcttctttagaggaggagtgtggtttgttatgtgatcaaaatcgagcaccggtcgtgtatatactgtctgatggcgccgagggaggcgatacg

SEQ ID NO: 793104 - DNA, 589 bp, Homo sapiens
  misc_feature: 62944.UNK.UNK.UNK.pb.heavy.1.raw 62944
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttcctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcaggccccagactgcaccagctgtacctgggagtgggaccgtcagtcttcctcttcccccaaacccaaactactcacactaaatcgagcacggtcgtgtatatactgtctgatggcgccgaggaggcgatacg

SEQ ID NO: 793105 - DNA, 686 bp, Homo sapiens
  misc_feature: 62952.UNK.UNK.UNK.pb.heavy.1.raw 62952
ctatgcgccttgccagcccgctcagacagtatataggaagtagtccttggaccaggcagcccagggccgctgtgcctctcggaggtgctcctggagcagggcgccagggggaagaccgatgggcccttggtggaggctgaggagacggtgacagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctgggcggaccagtgcatggcagagtcactgaaactgagtccggacgccaacacaggagagtctcagggaacgtcccaggctgggaccacgcctccccagactccaccagctgaacctgacactggacacctcttaaaagagcaacgaggaaaacccagctcagcccaaactccatggtgagtcctctgtgttcagtgctgatcaccggaatggaaacaccgccgacttctagtgctggctcctctccagcccctttcccttactgactcactaaatcgaggcaccggtcgtgtatatactgtctgatggcgcgagggaggcgatacg

SEQ ID NO: 793106 - DNA, 674 bp, Homo sapiens
  misc_feature: 62955.44.55.E11.1.pb.heavy.1.raw 62955
cgtatcgcctccctcgcgccatcagacagtatatacacgaccggtgctcgattagcactcgcacgtgggtttggggagaggagcccagcactggattccgaggtgtttccattcgtgatcagcactgaacacagagactcaccatgagtttggctgagctgggttctaccttgttggactttaaaaggtgtccagtgtgaggtgcggctgatggagtcggaggaggcttagtcagcctgggggtccagagactctctgtggcgcctctggctcaccgtcagcagcaactacatgagttgggccgcaggctccagggaagggctggagtggtctcagtcatttatactggtgattcacatactaacgcagactccgtgaaggccgattcaccatctccagggacaattccagacacggctatcttcaaatgacaacctgagaggcgacgacacggccgtctattactgtgcgagacagtcggcgctcggagtggtattattcgtttgacttctgggccagggaaccctggtcaccgcgtcgcctccgcctccacaagggcccatcggtcttcccctggccaccctctcaagagcacctctgggcacagcggccctggctgcctggtcaaggactacttcctatatactgtctgagcgggctggcaaggcgcatag

SEQ ID NO: 793107 - DNA, 707 bp, Homo sapiens
  misc_feature: 62965.44.27.C05.1.pb.heavy.1.raw 62965
cgtatcgcctccctcgcgccatcagacagtatatacacgaccggtgctcgatttagacgcgatcgaagggtttggggagccctggggagacgagcccagcactggaagtcgcccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccagtaggggggtccctgagactctcctgtgcagcctctggattcaccttcgataattggaatatgcagtgggtccgccaggctccaggcgaggggctggagtggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaacctggtcaccgtctcctcggccctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 793108 - DNA, 728 bp, Homo sapiens
  misc_feature: 62975.44.85.H08.1.pb.heavy.1.raw 62975
cgtatcgcctccctcgcgccatcagacagtatatacacgaccggtgctcgatttagtatcactcagtcgcgggggagctctggagaggagcccagcactagaagtcgcggtgtttccattccggtgatcagcactgaacacagaggactcaccatggagtttgggctgagctgggtttcctcgttgctcttttaagaggtgtccagtgtcaggtgcagctggtggagtctgggggagggcgtggtccagcctgggaggtcccctgagactctcctgtgcagcgtctggattcaccttcagtacctatggcatgcactggtccgccaggctccaggcaaggggctggagtgggtggcacttatatggtatgatggaagtaataaatacctatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaaggggcccatcggtcttccccctggcagccctcctccaagagcacctctggggcacagcggccctgggctgcctggcggtcagagactacttcctatatactgtctgagcgggctggcaaggcgcatag

SEQ ID NO: 793109 - DNA, 645 bp, Homo sapiens
  misc_feature: 62978.44.53.E09.1.pb.heavy.1.raw 62978
cgtatcgcctccctcgcgccatcagacagtatatacacgaccggtgctcgatttagagagagtgtgttgggtttggggggaagcacctgtggttcttcctcctgctggtggcggctcccagaatgggtcctgtctcagccgcagctgcggagtcgggccaggactggtgaagccttcggagaccctgtccctcacgtgcacggtctctggtgcctccatcgacagaagtatttctactggggctggatccgccagcccccaggagaggggctgcagtggattgggagtctctattatagtggaacacctactacaacccgtccctcaacggtcgagtcaccatatccgtggacacgtcgaggacacagttttccctgaagtgagttctgtggccgccgccgacacggctgtctactactgtgtcagacatgggtccgcctatggcagtcgtctcattctactacgcttgggacgtctggggccaagggacacggtcaccgtctctcatcctcagcctccaccaaggcccatcggtcttccccctggcgccctgctccaggaagcacctccgagagcacagcggcctggctgcctggtcaaggactacttcctatatacgtctgagcgggctggcaaggcgcatag

SEQ ID NO: 793110 - DNA, 662 bp, Homo sapiens
  misc_feature: 62988.44.12.B01.1.pb.heavy.1.raw 62988
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgccagctgcaggagtcgggcccaggactggtgaagccttcggagaccctgtccctcacctgcactgtctctggtggctccatcagcagtagtagttactactggggctggatccgccagcccccagggaaggggctgagtggattgggagtatctattatagtgggagcacctactacaacccgtccctcaagagtcgagtcaccatatcagtagacacgtccaagaaccagttctccctgaagctgagctctgtgaccgccgcggacacgccgtgtattactgtgcgagagtagggcagttcgtcaccaactactttgaccactggggccagggaaccctggtcaccgtctcctcagcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 793111 - DNA, 637 bp, Homo sapiens
  misc_feature: 62995.UNK.UNK.UNK.pb.heavy.1.raw 62995
cgtatcgcctccctcgcgccatcagacagtatatacacgaccgtgctcgatttagagagagtgtgttgggtttggggaagcacctgtggtttctcctcctgctggtggcgctcccagatgggtcctgtctcagccgcagctgcgggagtcgggccaggactggtgaagccttcggagaccctgtcctcacgtgcacggtctctggtgcctccatcgacagaagtattttctactgggcgtggatccgccagccccaggagagggctgcagtggattgggagtctctattatagtgggaacacctactacaaccgtcctcaacggtcgagtcaccatatccgtggacacgtcgagacacagttttccctgaagtgagttctgtggccgccgccgacacggctgtcactactgtgtcagacatgggtccgcctatggcaggtcgtctcaattctactacgcttggacgtcgggggccaagggacacggtcaccgtctcctccatcccagcctccaccaagggcccatcggtcttccccctggcgccctgctccagagccctccgagagcacagcggccctggctgcctggtcaaggactacttcctatatactgtctgagcgggctggcaggcgcatag

SEQ ID NO: 793112 - DNA, 707 bp, Homo sapiens
  misc_feature: 62997.44.67.G01.1.pb.heavy.1.raw 62997
cgtatcgcctccctcgcgccatcagacagtatatacacgaccggtgctcgattagagtatacatattgggtttgggggggagaggagcccagcactgggattccgaggtgtttccattcgtgatcagccactgaacacagaggactcaccatggagttttggctgagctgggttctccttgttggacttttaaaaggtgtccagtgtgaggtgcggctgatggagtctggaggaggcttagtccagcctgggggggtcccagaggactctcctgtgcagcctctgggctcaccgtcagcagccaactacatgagttgggtccgccaggcctccaggaaggggctggagtgggtctcagtcatttatactggtgatttcacatactacgcagactccgtgaagggccgattcaccatctccagggacaattccaggacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaaagggcccatcggtcttccccctggcaccctcctccaagagcacctctggggcacagcggccctgggctgcctggtcaaggactacttcctatatactgtctgagcgggctggcaaggcgcatag

SEQ ID NO: 793113 - DNA, 690 bp, Homo sapiens
  misc_feature: 63122.44.74.G08.1.pb.heavy.1.raw 63122
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctgtgcaactggtgcagtctgggactagaatgccgcaaccttggtcctcgtgaccctttcctgcacggcctctgaagtactaccagttccactacttataccatcaactggggtgcgccaggcccctggacaagggcttgagtggatgggtggaatcatcctctttttggctcactcacctacgcacgagacttccggggcagaattacgattacggcggacaagtccacagacacagtctccatgacaatgagttctttgaaatccgacgacacgcgccgtctactactgtgcgagaggtccgtacccagctcgcatggagcctttgagatctggggggcagggaaccctggtcattgtcactcagcttccacaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793114 - DNA, 669 bp, Homo sapiens
  misc_feature: 63126.44.74.G08.1.pb.heavy.1.raw 63126
ctatgcgccttgccagcccgctcagacagtatatagggaagtagtccttgaccaggcagcccagggccgctgtgcccccagaggtgctcctggagcaggcgccaggggaagaccgatgggcctttggtggagctgagggtgacatgacagggttccctgccccagatctcaaaggccatgcgagctggcggtacggactctcgcacagtagtagacgccgtgtcgtcggatcaaagactcattgtcatggagactgttcgtgacttgtccgcaggtaatcgtaattctgccccggaagtctcgtgcgtagtgagtgagccaaaaagagggatgattcacccatccactcaagcccttgtccaggggcctggcgcacccagttgatggtataagtgtgaactggtagtacttccagaggcgccgcaggaaagggtcaccgaggaccaaggttgcggcattctagtcccagactgcacagttgcacagggactggacacctgttgctgctgccacacaaagaggaacctccaggtccagtccatggtgatgagctgtgctccagggcttctttagagaggatgtggttgtatgtgatgctccccctgatagagctactaaatcgagcaccggtcgtgtatatactgtctgatggcgcgaggaggcgatacg

SEQ ID NO: 793115 - DNA, 700 bp, Homo sapiens
  misc_feature: 63145.44.62.F07.1.pb.heavy.1.raw 63145
ctatgcgccttgccagcccgctcagacagtatataggaagtagtccttgaccaggcagcccagggccgctgtgctctcggaggtgctcctggagcagggcgccaggggaagaccgatggcccttggtggaggctgaagagacggtcaccactgtcccccggccccaagtactaaaggtgtcatgggggtcaccgtggtcctggctttcaaacagtaatagacgcctgtgtcctcgggtctcaggtttttcatttggagaacaatttgtctgcgaattgtccctggaaatggtgaagcggccttcacggagtctccgtagaaagtgacaccaccagctccgatacttgagacccactccagtcccctccctggagcccggcggacccaggtcatgccataggcactaaaggtgaatccagaggccgcacaggagagggtcagggacctccaggccgaatcaggcccccccagactccaacaactgcacttcacacacgacacctttaaaaaagccacaagaaaaaggcagctcagcccaaactccatggagacttctctctgttcggtcctggtcaccaatgaagacacctgaaaatcccagggctggctcctctctcagagctcccctttccctttatgcgactactaaatcgagcaccggtcgtgtatatactgtctgatggcgcgaggaggcgatacg

SEQ ID NO: 793116 - DNA, 647 bp, Homo sapiens
  misc_feature: 63166.UNK.UNK.UNK.pb.heavy.1.raw 63166
cgtatcgcctccctcgcgccatcagacagtatatacacgaccgtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctgggcaaggaccacggtcaccgtctcctcatcctcagctccacaagggcccatcggtcttcccctggcgccctgctccaggagcacctccgagagcacagcggccctggctgcctggtcaaggactacttcctatatactgtctgagcgggctggcaaggcgcatag

SEQ ID NO: 793117 - DNA, 680 bp, Homo sapiens
  misc_feature: 63169.44.72.G06.1.pb.heavy.1.raw 63169
gtatataggaagtagtccttgaccaggcagcccagggccgctgtgctctcggaggtgctcctggagcagggcgccagggggaagaccgatgggcccttggtggaggctgaggagacggtggaccagggttccctgacccagtagtcaatgagccacccagcgcctcccgcacaataatacaccagccgtgtcctcgacttctcagactgttcatttgcagatacagtgagttcttggcgtttgtctctggagatggtgaatcggcccttcaacagagtccacataagtgttgtctcagttccatctttcttcatgatggccaccccactccagccccttccctggagcctggcggacccagttcatccaataactactaaaggtgaatccagaggctgcacaggagagtctcagggaccccccaggctggaccaagcctcccccagactccaccagtttgcacctcacactggacaccttctaaaatagcaacaaggaaaaacccagcctcagtcccaattccatggtgagtcctctgtgctcagtgctgatcaccaagtggaaaggccttggagtccagggctaaggctccctctctccccttttccccttgcagtcgtagctaaaatcgagcaccggtcgtgtatatactgtctgatggcgcgagggaggcgattacg

SEQ ID NO: 793118 - DNA, 666 bp, Homo sapiens
  misc_feature: 63210.44.12.B01.1.pb.heavy.1.raw 63210
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtaggggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793119 - DNA, 696 bp, Homo sapiens
  misc_feature: 63217.UNK.UNK.UNK.pb.heavy.1.raw 63217
cgtatcgcctccctcgcgccatcagacagtatatacacgacggtgctcgatttagctgcgtcacgatctctctgggagctctcagagaggtgccttagccctggattccaaggcattttccacttggtgatcagcatgaacacagagactcaccatggagttggggctgcgctgggttttccttgttgctattttagaagtgtccactgtgaggtgcggcctggtggagtctgggggaggcttggtacagcgggggggtcctgagactctcctgtgcagcctctggattcatcttcagtgactatgcatgaactgggtcgccaggctccagggaaggggctggagtgggttcatatttaatattggctggagataccacctatacgcagactctgtgaagggccgatcacaattcagggacaatgccaagaactcactgtatctggaaatgaacagcctgagagacgaggacacggctgtctacttctgtcgagagatcgggccacttggtcagtggctggtttgactactggggccggggaacccctggtcaccgtctcctcagcctccaccaagggcccatcggtcttccccctggcgccctgctccaggagcacctcgagagcacagcggcctggctgcctggtcaaggactacttcctatatactgtctgagcgggctggcaaggcgcatag

SEQ ID NO: 793120 - DNA, 739 bp, Homo sapiens
  misc_feature: 63218.44.86.H09.1.pb.heavy.1.raw 63218
cgtatcgcgcctccagcgccgccatcagaccagtatatacacgaccggtgctcgatttagtgctatagacttgggttgggagctctgggaggaggagcccagcacagaagtcggcggtgtttccagtcggtgatcagcaccgaacacagaggactcaccatggagtttgaggctgacctgggttttcctcgttgctcttttaagaggtgtccagtgtcaggtgaagctggtggagtctgggggaggcgtggtccagcctgggaggtccctgagactctcctgtgtagcgtctggattcacctttcaacagacatggcatgcactgggtccgccaggctccaggcaaggggactggaagtgggtggcacttatatggtatgatggaagtaataaatattatgtagattccgtgaagggccgatttcaccatctccagagacaattcgaagaaacacactatatctggaaatgaatagccctgagagccgagggacacggctgtctactactgtgcgagagatgggctcgtggatacagatatgacatgctctactccaaatggtatggacgcctggggccaagggaccacggtcgccgtctcctcagcctccaccaagggcccatcggtcttcccctggcaccctcctccaagagcaacctctggggcacagcggccctgggctgcctggtcaaggactacttcctatatactgtctgagcgggctggcaaggcgcatag

SEQ ID NO: 793121 - DNA, 646 bp, Homo sapiens
  misc_feature: 63233.UNK.UNK.UNK.pb.heavy.1.raw 63233
ctatgcgccttgccagcccgctcagacagtatataggaagtagtccttgaccaggcagccagggccgctgtgcccccagaggtgctcctggagcagggcgccaggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactctgagggacggagagtagtacgtcgccccagtataatggatgtcaccaatccactccattcccctccctgggggctgccgatccagccccaagaatgatcagaactgatggaaactccagagacagtgcagatgagagacagggttcccgaaggcctcaccagtcctggcccgactcctgcagctgcactgggacaggacccatctgggagctgcaccagcaggaggaaaaaccacaggtgcttcatgttcttgcacaggaggtccttgactctcagaaagcatccccaaacccaagtctatagcactaaatcgagcaccgtcgtgtatatactgtctgatggcgcgagggaggcgatacg

SEQ ID NO: 793122 - DNA, 614 bp, Homo sapiens
  misc_feature: 63264.UNK.UNK.UNK.pb.heavy.1.raw 63264
gaaggctgggcaggctatgcaccctggtccaggtcaaaagctgcggacccgctagcggccatcttggccacctaggggtcccgcagattcatattgtcgtctagcatggcacaatgctgcaaacccagcttgcaatgcccacacgcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccccaagcaggctatgtgggggggggtgataggggtggattctatttcctatcccatcccctaggatctcaattaagttactagcgagttaaatgtctgtagcgatcccgtcagtcctatcgcgcgcatcaagacctggttggttgagccgtgcagtagatcatcgataagctgcgagttaggtcatcccagaccgcatctggcgcctaaacgttcagtgtagctaaggcgtcaccttcgactggtctaaaggcaatatgtcgtccttagctccaagtccctagcaagcgtgtcggg

SEQ ID NO: 793123 - DNA, 586 bp, Homo sapiens
  misc_feature: 63270.UNK.UNK.UNK.pb.heavy.1.raw 63270
gaaggctgggcaggctatgcaccctggtccaggtcaaaagctgcggaacccgctagcggccatcttggccactaggggtccgcagattcatattgtcgtctagcatgcacaatgctgcaaacccagcttgcaatgcccacagcagcggccaatctttacgccacgttgaattgtttattacctgtgactggctatggcttgcaacgccactcgtaaaactagtacttgcggtaggggaagtagacaaaccattactccacttccgagttcaactcattccaacacgaaataaaagtaactcaacacccaagcaggctatgtggggggtgatagggtggattctatttcctatcccatcccctaggatctcaattagttactaagcttaaatgctgtagcgatcccgtcagtcctatcgccgcatcaaacctggttgggtgagcgtgcagtagatcatcgatagctgcgagttaggtcatcccagaccgcatctggcgcctaaacgttcagtggtagctaaggcgtcaccttcgactgtctaaaggcaatatgtcgtcctagctccaagtcctagcaagcgtgtcgg

SEQ ID NO: 793124 - DNA, 711 bp, Homo sapiens
  misc_feature: 63274.44.36.D03.1.pb.heavy.1.raw 63274
ctatgcgccttgccagcccgctcagacagcgtatataggaagtagtcccttgaccaggcagcccagggcgccgctgtgctctcgaggtgctcctggagcagggcgccagggggaagaccgatgggcccttgtgggaaggctgaggagacggtgaccagggttccctgcgccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaaggctggcaactttgtttttactgcggccaagccactccagcccttccctggagcctggcggaccagtccatatagtggtcactgatggtgatccagaggcgacacaggagagtctcagggaccctccaggctggaccaagtctcccccggactccaccaactgcacttcactctggacaccttgtaaaataacaacaaggaaaacccagctcagcccgaacctccatggtgagtcctctgtgttcagtgctgatcaccaaatgaaaacacctgggaattctggggctggggctccgctctcagagctccccaagaggagatcgtgacgcagctaaatcgagcaccggtcgtgtatatactgtctgatggcgcgagggaggcgatacg

SEQ ID NO: 793125 - DNA, 553 bp, Homo sapiens
  misc_feature: 63276.UNK.UNK.UNK.pb.heavy.1.raw 63276
cgtatcgcctccctcgcgccatcagacagtattacacgacccggtggctcgatttagactagcagtaagggctgaggggtgaagaagcctgggccctcgtgaaggtctcctgcaaggcttctggatacaccttcaccaattattgatatcaactggtgcgacaggccactggacaagggcttgagtggatgggatggatgaaccctaacagtggtaacacaggctatgcacagaagttccagggcagagtcaccatgacccaggaacacctccataaacagcagcctacatggagctgagcagcctgagatctgaggacacggccgtgtattactgtgcgagatcccgaagtatagcagctcgtcggggaggtggttcgaccccctgggccagggaaccctggtcaccgtctccttcagcttccaccaagggcccatcggtcttcccctggcgccctgctccaggagcacctctggggggcacagcggccctgggctgcctggtcaaggactacttcctatatactgtctgagcgggctggcaaggcgcatag

SEQ ID NO: 793126 - DNA, 665 bp, Homo sapiens
  misc_feature: 63277.44.74.G08.1.pb.heavy.1.raw 63277
cgtatcgcctcctccgccatcagacagtaatacacgaccggtgctcgattagtagctctatcaggggggagcatcacatacaaccacatccctctaaagaagcccctggggagcacggctccaccatggactggactggagcctctttgtggtggcagcagcaacagggtccagtccctgtgactgtgcagtctgggactagtgccgcaccttgtcctcggttgaccctttcctgcacggcctctgaagtactaccagttccacacttataccatcaactggtgcgccaggccctggacaaggcttgatggatgggtgaatcatccctcttttttggctcactcacctacgccacgagacttccggggcagaatacgttaccgcgacaagtccacagacacagtctccatgacaatgagttctttgaaatcgacgacacggccgtctactactgtgcgagaggtccgtaccccagctcgcatggagccctttgagatctgggggcagggaaccctggtcattgtcgacctcagcttccaccaagggcccatcggtcttcccccctggcgccctgctccaggagcactctgggggcacagcggcccgggctgcctggtcaaggactacttcctatatactgtctgagcggctggcaaggcgcatag

SEQ ID NO: 793127 - DNA, 615 bp, Homo sapiens
  misc_feature: 63287.UNK.UNK.UNK.pb.heavy.1.raw 63287
cgtatcgcctccctcgcgccatcagacagtatatacacgaccggtgctcgatttagtgggagtagtttgggtttgggggggaagaggagactgacgggtccactcccaggtacagctgtgcagtctggggctgaggtgaacgaagcctggggcccggcagtgccacagtctcctgcacggcttctggatcacttcatcaattatgatattaactgggtgcgacaggcgccgctggacaagggctggagtggcatgggatggatgaagcccttatagtggcaacacgggcttgccccagaaggttccgaaaggcagagttgtatgacaggagcacgcctccccagtagcagtctacatggaactgagcagcctgagatctgaggacacggccgtgtatttctgtgcgagagccaccagcacctggcttgacttgtgggggccagggaaccctggtcaccgtctcctcagcctccaccaagggcccatcggtcttccccctggcgccctcctccaggagcaccttccgagagcaacagcggccctgggctgcctggtcaaggactacttccctatactacatcgtcagtagcggctgagcaaggcgcatgaccatag

SEQ ID NO: 793128 - DNA, 676 bp, Homo sapiens
  misc_feature: 63288.UNK.UNK.UNK.pb.heavy.1.raw 63288
ctatgcgccttgccagcccgctcagacagtatataggaagtagtccttgaccaggcagcccagggccgctgtgccccagaggtgctcctggagcagggcgccaggggaagaccgatgggcccttggtggaagctgaggtgacaatgaccagggttccctgcccccagatctcaaggctccatgcgagctggggtacggacctctcgcacagtagtagacggccgtgtcgcgtcggattttcaaagaactcattgtcatggagactgtgtctgtggacttgtccgcgcggtaatcgtaattctgccccggaagtctcgtgcgtaggtgagtgagccaaaaagagggatgattccacccatccactcaagcccttgtcccaggggcctggcgcacccagttgatggtataagtagtggaactggtagtacttccagaggccgtgcaggaaagggtcaccgaggaccaaggttgcggcatctagtcccagactgcaccagttgcaccagggactggacacctgttgctgctgccaccacaaagaggaacctccaggtccagtccatggtgatgactgtgctcccaggggcttctttagaggaggaatgtggttgtcagtagatctaaatcgagcacggtcgtgtatatactgtctgatgggcgcgagggaggcgatacg

SEQ ID NO: 793129 - DNA, 685 bp, Homo sapiens
  misc_feature: 63319.44.36.D03.1.pb.heavy.1.raw 63319
tatgcgccttgccagcccgctcagacagtatataggaagtagtccttgacaggcagcccagggccgctgtgctctcggaggtgctcctggagcagggcgccagggggaagaccgatggcccttggtggaggctgagagacggtgaccagggttccctggcccagtggacagttcctgatataaacacaacaaataatacatgccgtgtcctcggttttcaggttagtcattcgcagaatcaatgagttcttgaagtcatctcttgagagggtgaatctgcttcacagacgcggcgtactctgtgataaagctggcaactttgttttactgcgccaagccactcagcccttccctggagcctggcggacccagtccatatagtgtcactgatggtgaatccagaggcgacacaggagagtctcagggacctccaggctggaccaagtctccccgactccaccaactgcacttcactctggacaccttgtaaaataacaacaaggaaaccagctcagcccgaactccatgtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793130 - DNA, 687 bp, Homo sapiens
  misc_feature: 63353.44.36.D03.1.pb.heavy.1.raw 63353
cgtatcgcctccctcgcgcatcagacagtatatacacgaccggtgctcgattagctgcgtcacgatctctcttgggggagagcggagcccagcccccagaattcccaggtgttttcatttggtgatcagcactgaacacagaggactcaccatggagttcgggctgagctgggttttccttgttgttattttacaaggtgtccagagtgaagtgcagttgtggagtccgggggagacttggtccagcctggagggtccctggactctcctgtgtgtcgcctctggattcccatcagtgaccactatatggactgggtccgccaggctccagggaaggggctggagtggcttggcgcagtaaaacaaagttgccagctttatcacagagtacgccgcgtctgtgaaagccagattcacctctcaagagatgacttcaagaactcattgattctgcgaatgactacctgaaaaccgagggacacgggcatgtattattgtgttgtgtttatatcaggaactgtccactggggccaggaaccctggtcaccgtctcctcacctccaccaagggcccatcgtcttcccctggcgccctgctccaggagcacctccgagagcacagcggccctgggctgcctggtcaaggactacttcctatatactgtctgagcggctggcaagggcatag

SEQ ID NO: 793131 - DNA, 640 bp, Homo sapiens
  misc_feature: 63364.44.19.B08.1.pb.heavy.1.raw 63364
ctatgcgccttgccagcccgctcaaacagtataggaagtagtccttgaccaggcagcccagggccgctgtgctctcggaggtgctcctggagcagggcgccagggggaagaccgatgggcccttggtggaggctgatgagacggtgacctggattccctggccccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggcctttcgggggggctgccgcacccagacaacgccctctccaggagtgacgagtgagaagcctgagacggtgcaggtcagcgtgagggtctgtgtgggtttcaccaatgtagggccagactctttcacggtgatctgggacaggccccatgaaggatggtcagcagcaggagcgtggagcaaagtgtgtccatggtgggcacaggagtccccttactgactcactaatcgagcaccggtcgtgtatatactgtctgatggcgcgagggaggcgatacg

SEQ ID NO: 793132 - DNA, 659 bp, Homo sapiens
  misc_feature: 63379.UNK.UNK.UNK.pb.heavy.1.raw 63379
gcccgctcagacagtatataggaagtagtccttgaccaggcagcccagggccgctgtgccccccagaggtgctcttggaggagggtgccaggggaagaccgatgggcccttggtggaggctgaggagacggtggaccagggttccctggccccagtgggtcaaagtaagttggtgacgaactgccctactctcgcacagtaatacacacgggccgtgtccgcggcggtcacagagctcagcttcagggagaactggttcttgggacgtgtctactgattatggtgactcgactcttgagggacgggttgtagtaggtgctcccactataatagatactcccaatccactccagccccttccctgggggctggcggatccagccccagtagtaactactactgctgatggagccaccagaggacagtgcaggtgaggacagggtctccgaaggcttcaccagtcctgggcccgactcctgcagctgcagctgggacaggacccatctgggaccgccaccagcaggaaggaagaaccacaggtgcttcatgttcttgcacaggaggtccatgactctcagaaagcccccgcggaatctacacctactaaatcgagcaccggtcgtgtatatactgtctgatggcgcgagggaggcgatacg

SEQ ID NO: 793133 - DNA, 687 bp, Homo sapiens
  misc_feature: 63448.44.72.G06.1.pb.heavy.1.raw 63448
cgtatcgcctccctcgcgccatcagacagtatatacacgaccggtgctcgatttagctacgactgcaagggaaaggggagagagggagccttagcctggactccaaggcctttccactggtgatcagcactgagcacagaggactcaccatggaattggactgagctgggttttccttgttgctattttagaaggtgtccagtgtgaggtgcaactggtggagtctgggggaggcttggtccagcctgggggtccctgagactctcctgtgcagcctctggattcacctttagtagttattggatgaactgggtccgccaggctccaggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 793134 - DNA, 703 bp, Homo sapiens
  misc_feature: 63456.UNK.UNK.UNK.pb.heavy.1.raw 63456
ctatgcgcccttgccagcccgctcagacagtatatataggaagtagtccttgaccaggcagcccagggccgctgtgccccccagaggtgctcttggaggagggtgcagggggaagaccgatggccccttggtggaggcggaggcgacggtgaccagggttccctggccccagaagtcaaacgaataataaccactccgagcgccgacttgtctcgcacagtaatagacggccgtgtcgtcgcctctcaggttgttcattttgaagataaacgtgttcctggaattgtccctggagatggtgaatcggccttcacggagtctgcgtagtatgtgaaatcaccagtataaatgactgagaccactccagccccttccctggagcctggcggaccaactcatgtagttgctgctgacggtgagccagaggctgcaacaggagagtctctgggaccccccaggctggactaagcctcctccagactccatcagcgcactcacactggacaccttttaaaagtccaacaaggagaaccagctcagccaaaactccatggtgagtctctgtgttcagtgctgatcaccgaatggaaacacctcggaatcccagtgctgggctcctctccccccaaaccaacgtgcgagtgctaaatcgagcaccgttcgtgtatatactgtctgatggcgcgagggaggcgatacgatc

SEQ ID NO: 793135 - DNA, 701 bp, Homo sapiens
  misc_feature: 63457.44.36.D03.1.pb.heavy.1.raw 63457
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtgcttggccgcagtaaaaacaagttgccagctttatcacagagtacgcgcgtctgtgaaagccagattcaccctctcaagagatgacttcaagaactcattgattctgcgaatgactaacctgaaaccgaggacacgggcatgtattattgtgttgtgtttatatcaggaactgtccactgggggccaggaaccctggtcaccgtctcctcagcctccaccaagggcccatcggtcttccccctggcgccctgctccaggagcacctccgagagcacagcggccctgggctggcctggtcaaggactacttcctatatactgtctgagcgggctggcaaggcgcatag

SEQ ID NO: 793136 - DNA, 704 bp, Homo sapiens
  misc_feature: 63477.UNK.UNK.UNK.pb.heavy.1.raw 63477
cgtatcgccctcctcgcgccatcagacagtatatacacgaccggtgctcggattttagtgtcgtcgcaagagagaggagccccagccgtgagattcccaggagtttccacttggtgatcagcactgagcacagaccaccaaccatggagtttgggctaatcttgattttccttgtagttttttttagaaggtgtccagtgcgaggggccgactggcggagtcggggggggcttggcacagccagggcggtctctgagactctcctgtgtagtctcaggattcagtcttagtgattatcacttggcctgggtccgtcaggctccagggaagggcttgagtggactcactttcgtcagaatgaaacgtttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtccccgtctcttcagcttccaccaagggcccatcggtcttccccctggcgccgctgctccaggagcacctctgggggcacagcggccctgggctgcgctggtcaagggactacttcctatatactgtctgaggcgggctggcaaggccgcata

SEQ ID NO: 793137 - DNA, 679 bp, Homo sapiens
  misc_feature: 63480.44.74.G08.1.pb.heavy.1.raw 63480
ccgctcagacagtatataggaagtagtccttgaccaggcagcccagggccgctgtgcccccagaggtgctcctgagcagggcgccagggggaagaccgatggggcccttggtggaagctgaaggtgacaatgaccagggttccctgccccagatctcaaaggctccatgcgagctggggtaggacctctcgcacagtagtagacggccgtgtcgtcggatttcaaagaactcattgtcatggagactgtgtctgtggacttgtccgcggtaatcgtaattcttgccccggaagtctcgtgcgtaggtgagtgagccaaaaagagggatgattccacccatccactcaagcccttgtccaggggcctggcgcacccagttgatggtataaagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccattggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 793138 - DNA, 648 bp, Homo sapiens
  misc_feature: 63481.44.23.C01.1.pb.heavy.1.raw 63481
ctatgcgccttgccagcccgctcagacagtatataggaagtagtccttgaccaggcagcccagggccgctgtgcccccagaggtgctcctggagcagggcgccaggggaagaccgatgggccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgaggaggcgatacg

SEQ ID NO: 793139 - DNA, 725 bp, Homo sapiens
  misc_feature: 63509.UNK.UNK.UNK.pb.heavy.1.raw 63509
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtgtcccttggccccagacgtccataccgtagtagtagtcccagcaggtggtagtactacaatatgtcctcgccacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttccagtgctgatcaccgaatggaaacaccgccgacttctagtgctgggctcctctccagagctccccgcgactgagtgatactaaatcgagcaccggtcccgtgtatatactgtctgatggcgcgagggaggcgatacg

SEQ ID NO: 793140 - DNA, 691 bp, Homo sapiens
  misc_feature: 63527.UNK.UNK.UNK.pb.heavy.1.raw 63527
cgtatcgcctcctcgcgccatcagacagtatataccaccggtgctcgatttagcactcgcacgttggtttgggggagaggagcccagcactggattccgaggtgtttccattcggtgatcagcactgaacacagaggactcaccatggagttttggctgagctgggttctccttgtggactttttaaaaggtgtccagtgtgaggtgcggctgatggagtctggaggagggcttagtccagcctgggggtcccagagactctcctgtggcagcctctgggctcaccgtcagcagcaactacatgagttgggtccgccaggctcagggaaggggctggagtggtctcagtcatttatactggtgatttcacatactacgcagactccgtggaaggcgattcaccatctccaggacaattccaggaacacggtttatcttcaaatgaacaacctgagagcgacgacacggccgtctattactgtgcgagacaagtcggcgctcgagtggttattattcgttttgacttctggggcagggaaccctggtcaccgtcgcctccgccctccaccaagggcccatcggtcttcccctggcaccctcctccaagagcactctggggcacagcggcctgggctgcctggtcaaggactacttcctatatactgtctgagccggctggcaaggcgcatag

SEQ ID NO: 793141 - DNA, 552 bp, Homo sapiens
  misc_feature: 63538.44.43.D10.1.pb.heavy.1.raw 63538
ctatgcgccttgccagcccgctcagacagtatataggaagtagtccttgaccaggcagcccagggccgctgtgcccccagaggtgctcctgggagcagggcgccaggggaagaccgatgggcccttggtggaagctgaggagacggtgaccagggttccctggccccaggggtcgaaccacctccccgacgagctgctatactttcgggatctcgcacagtaatacacggccgtgtcctcagatctcaggctgctcagctccatgtaggctgtgtttatggagggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggcccccaggcttcttcacctcagccccttactgctagtctaaatcgagcaccggtcgtgtatatactgtctgatggcgcgagggaggcgatacg

SEQ ID NO: 793142 - DNA, 604 bp, Homo sapiens
  misc_feature: 63559.UNK.UNK.UNK.pb.heavy.1.raw 63559
cccgcacgcttgctagggacttggagctaaggacgacatattgcctttagacagtcgaaggtgacgccttagctacactgaacgtttaggcgccagatgcggtctgggatgacctaactcgcagcttatcgatgatctactgcacgcctcaaccaaccaggtcttgatgcgcgcgatagactgacgggatcgctacagacatttaactccgctagtaacttaattgagatcctaggggatgggataggaaatagaatccacccctatcacccccccacatagcctgcttgggtgttgagtttacttttatttcgtgttgaatgagttgaacttccgggaagtggagtaatgggtttgttctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgccagccttc

SEQ ID NO: 793143 - DNA, 700 bp, Homo sapiens
  misc_feature: 63562.44.55.E11.1.pb.heavy.1.raw 63562
cgtatcgcctccctcgcgccatcagacagtatatacacgaccggtgctcgatttagcactcgcacgttgggtttgggagagagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagccagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtgttattattcgtttgacttctggggccagggaaccctggtcaccgtcgcctccgcctccaccaagggccatcggtcttcccctggcaccctccttccaagagcacctctgggggcacagcggccctgggctgcctggtcaaggactacttcctatatactgtctgagcggggctggcaaggcgcatag

SEQ ID NO: 793144 - DNA, 704 bp, Homo sapiens
  misc_feature: 63565.44.55.E11.1.pb.heavy.1.raw 63565
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagacttctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793145 - DNA, 698 bp, Homo sapiens
  misc_feature: 63570.44.36.D03.1.pb.heavy.1.raw 63570
cgtatcgctccctcgcgccatcagacagtatatacacgaccggtgctcgatttagctgcgtcacgatctctcttggggagctctgagagcggagccccagcccagaattcccaggtgttttcatttggtggatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatccagtgaccactatatggactgggtccgccaggctccagggaagggctggagtggcttggccgcagtaaaaacaaagttgccagctttatcacagagtacgccgcgtcctgtgaaagccagattcaccctctcaagagatgacttcaagaactcattgattctgcgaatgactaacctgaaaccgaggacacgggcatgtattattgtgttgtgtttatatcaggaactgtccactggggccaggaacctggtcaccgtctctcagctccaccaagggcccatcggtcttccccctgcgccctgctccaggagcacctccgagagcacagcggccctgggctgcctggtcaaggactacttcctatatactgtctgagcgggctggcaaggcgcatag

SEQ ID NO: 793146 - DNA, 597 bp, Homo sapiens
  misc_feature: 63573.UNK.UNK.UNK.pb.heavy.1.raw 63573
aggctgggcaggctatgcaccctggtccaggtcaaaagctgcggacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggtaggggaagtagacaaacccattactccactcccggaagttcaactcattccaacacgaaataaaagtaaactcaacaccccagcaggctatgtggggggtgataggggtggattctatttcctatcccatcccctaggatctcattaagtactagcgagttaaatgtctgtagcgatccgtcagtcctatcgcgcgcatcaagactggttgttgagcgtgcagtagatcatcgataagctgcgagttaggtcatcccagaccgcatctggcgcctaaacgttccagtggtagctaaggcgtcaccttcgactgtctaaaggcaatatgtcgtccttagctccaagtccctagcaagcgtgtcggg

SEQ ID NO: 793147 - DNA, 701 bp, Homo sapiens
  misc_feature: 63594.UNK.UNK.UNK.pb.heavy.1.raw 63594
ctatgcgcctgccagcccgctcagacagtatataggaagtagtccttgaccaggcagcccagggccgctgtgctctcggaggtgctctggagcaggccgccagggggaagaccgatgggcccttggtggaggctgaggagacggtgaccagggttccctggccccagtggacagttcctgaatataaacacaacacaataatacatgcccgtgtcctcggttttcaggttagtcattcgcagaatcaatgagttcttgaagtcatctcttgagaggtgaatctggctttcacagacgcggcgtactctgtgataagctggcaactttgtttttactgcggccaagccactccagcccttccctggagcctggcggacccagtccatatagtggtcactgatggtgaatccagaggcgacacaggagagtctcagggaccctcccaggctggaccaagtctcccccggactccaccaactgcacttcacctctggacaccttgtaaaataacaacaaggaaaacccagctcagcccgaactccatggtgagtcctctgtgttcagtgctgatcaccaaatgaaaaccaccggaattctggggctgggctcgctctcagagctccccaagagagatcgtgacgcagctaaatcgagcaccggtccgtgatagtatagactgatggcgcgagggaggcgatacg

SEQ ID NO: 793148 - DNA, 1275 bp, Homo sapiens
  misc_feature: 63616.UNK.UNK.UNK.pb.heavy.1.raw 63616
ctatgcgccttgccagcccgctcaggacagtatataggaagtagtccttgacccaggcagcccagggccgctgtgccccagaaggtgctcctggagcagggcgccagggggaagaccgatgggcccttggtggaagctgaggagacagtgaccagggtgccacggcccatagattggaaagacagtctcgcctcgcacagaaataacgcagcgtgtccgcggcggtcacggaggtcagtttccaggagaagcggtccatggacggtgtcctcgaaaaggtgagacgactcttgagggacggagagtaaagtacgttcgccccagtataatggatgtcaccaatccactccattcccctcctgggggctgccggatccacgccccaagaaatgatcagaactgattggaaactcccagagaagtgcagatagaagacagggttcccgaaggctcaccagtcctgggcccgactcctgcagctgcacctgggacaggaccccatctgggagctgccaccagcaggaggaagaaaaaccacagtgcttcatgttcttgcacaggaggtccttgactctcagaaagcatcccaaacccaagtctatagcactaaatcgagcaccgtcgtgatagtatagactgatggcgcgagggaggcgatacgctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtgggtccttggccccagacgtccataccgtagtagtagtatgcaactccccgaactcccgcccggctcttgcacagtaatacacagccgtgtcctcggctctcagactgttcatttgcagatacagcgtgttcttggcgttgtctctggagatggtgaatcggccttcacggagtccgcgtagctgtgctactcccatcactattaatacgtgagacccacaccagccccttccctggagcttggcggacccagtgcatcagtagctactgaaggtgaatccagaggctgcacaggagagtctcagggacccccccaggctgaaactaagcctccccggactccaccagctgcacctcacactggacacctttaaaatagcaacaaggaaaacccagctatcagatactaaatcgagcaccgttcgtgttatactgtctgatggcgcgagggaggcgatacg

SEQ ID NO: 793149 - DNA, 682 bp, Homo sapiens
  misc_feature: 63625.44.12.B01.1.pb.heavy.1.raw 63625
cgtatccgcctccctcgcgccatcagacagtatatacacgaccggtgctcgattagtagtgtagattccggcggggggcttttctgagagtcatggacctcctgtgcaagaacatgaagcacctgtgttcttcctcctgctgtggcggctccagatgggtcctgtcccagctgcagctgcaggagtcgggcccagactggtgaagccttcggagaccctgtccctcacctgcactgtctctggtggctccatcagcagtagtagttactactggggctggatccgccagcccccagggaaggggctggagtggattgggagtcatctattatagtgggagcacctactacaacccgtccctcaagagtcgagtcaccatatcagtagacacgtcaagaaccagttctcccctgaagctgagctctgtgaccgccgccggacacggccgtgtattactgtgcgcgagagtcagggccagtttcgtcaccaactactttgaccactgggccagggaaccctggtcaccgtctcctcagcctccaccaaggcccatcggtcttccccctggcaccctcctccaagagcacctcctggggcacagcgccggcctgccgcctggcgtcaaggactaacttccctatatacaggctgtctgagcggcgctggcagggcgcaagctcag

SEQ ID NO: 793150 - DNA, 702 bp, Homo sapiens
  misc_feature: 63654.44.55.E11.1.pb.heavy.1.raw 63654
ctatgcgccttgccagcccgctcagacagtatatataggaagtagtccttgaccaggcagccagggccgctgtgcccccagaggtgctcttggaggagggtgccagggggaagaccgatgggccctggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggcccttcacggagtctgcgtagtatgtgaaatcaccagtataaatgactgagacccactccagccccttccctggaggcctggcggaccaactcatgtagttgctgctgacggtgagcccagaggctgcacaggagagtctctggaccccccaggctggactagcctcctccagactccatcagccgcacctcacactggacaccttttaaaagtccaacaaggagaacccagctcagccaaaactccatggtgagtcctctgtgtttcagtgctgatcaccgaatggaaacacctcggaatcccagtgctgggctcctctccccccaacccaacgtgcgagtgctaaatcgagcaccggtcgtgtatatactgtctgatggcgcgagggaggcgatacg

SEQ ID NO: 793151 - DNA, 701 bp, Homo sapiens
  misc_feature: 63706.44.73.G07.1.pb.heavy.1.raw 63706
cgtatcgcctcctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcccgagaggcgaggactcggctctgtattactgtgcgagatcgggaagtggcagcagctattatcgggcgtttcactggggccagggacactggtcaccgtctcctcagcctccaccaagggcccatcggtcttcccctggcgccctgctccaggagcaccctccgagagcacagcggccctgggctgcctggtcaaggactacttcctatatactgtctgagcgggctggcaggcgcatag

SEQ ID NO: 793152 - DNA, 707 bp, Homo sapiens
  misc_feature: 63708.44.62.F07.1.pb.heavy.1.raw 63708
cgtatcgcctccctcgcgccatcagacagtatatacacgaccggtgctcgatttagtagtcgcataaagggaaaggggagctctgagagagaggagcccagccctgggattttcaggtgtcttcatttggtgaccaggaccgaacagagagaagtctccatggagtttgggctgagctgccttttttcttgtggcttttttaaaggtgtcgtgtgtgaagtgcagttgttggagtctggggggcctgattcgcctgggaggtccctgaccctctcctgtgcggcctctgatcacctttagtgcctatggcatgacctgggtccgccgggctccagggaggggactggagtgggtctcaagtatcggagctggtggtgtcactttctacggagactccgtgaagggccgcttcaccatttccagggacaaattcgccaggacaaattgtttctccaaatgaaaaactgagacccgaggacacaggcgtctattactgtttgaaagccaggaccacggtgacccccatgacaccttagtacttggggccggggacagtggtgaccgtctcttcaggcctccaccaagggcccatcgtcttccccctggcgccctgctccaggagcacctccgagagcacagcggccctggctgcctggtcaaggactacttcctatatactgtctgagcggggctggcaaggcgcatag

SEQ ID NO: 793153 - DNA, 629 bp, Homo sapiens
  misc_feature: 63730.UNK.UNK.UNK.pb.heavy.1.raw 63730
ctatgcgccttgccagcccgctcagacagtatataggaagtagtcccttgaccgggcagcccagggccgctgttgccccccagaggtgctcctggagcagggcgccagggggaagaccgatgggcccttggtggaagctggaggagacgggggaccgtggtccttggccccagacgttccataccgtagtaagtagtatgcaactccccgaactcccgcaccggctcttgcaacagtaatacacagccgtgttcctcggctctcagactgttcatttgcagatacagcgtgttcttggcgttgtctctggaggatggaatcggcccttcacggagtccgcggtagcttgtgctactcccatccactattaatacgtgagacccacaccagcccttccctggagcttggcggaccaggtgcatccagtagctactgaaggtgaatccagaggctgcacaggaggagtctcaggaccccccaggctgactaagcctcccccggaactccaccagctgcacctcacactggacaccttttaaaatagcaacaaggaaaaccagctattcagatactaaatcgagcaccggtcgtgtataatactgtctgatggcgccgagggaggcgatacg

SEQ ID NO: 793154 - DNA, 601 bp, Homo sapiens
  misc_feature: 63737.UNK.UNK.UNK.pb.heavy.1.raw 63737
gaaggctgggcagggctatgcacccctggtccaggtcaaaagctgcggaacccgctagcggccatcttggccactaggggtcccgcagattcatattgtcgtctagcatggcacaatgctgcaaacccagcttgcaatgcccacagcaagcggccaatctttacgccacgttgaattgtttattacctgtgactggctatggcttgcaacgcactcgtaaaaactagtactttgcggttaggggaagtagacaaacccattactccacttcccgaagttcaactcattccaaaacgaaataaaagtaaactcaacacccaagcaggctatgtggggggtgatagggtggattctatttctatcccatcccctaggatctcaattaagttactagcgagttaatgtctgtagcgatcccgtcagtcctatcgcgcgcatcaagacctggttggttgagcgtgcagtagatcatcgataagctgcgagttagtcatcccagaccgcatctggcgcctaaacgttcagtggtagctaagcgtcaccttcgactgtctaaaggcaatatgtcgtccttagctccaagtcctagcaagcgtgtcgg

SEQ ID NO: 793155 - DNA, 707 bp, Homo sapiens
  misc_feature: 63741.44.36.D03.1.pb.heavy.1.raw 63741
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagggttccctggccccaagtggacagttcctgatataaacacaacacaataatacatgcccgtgtcctcggtttttcaggttagtcattcgcagaatcaaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaaaccagctcagcccgaactccatggtgagtcctctgtgttcagtgctgatcaccaaatgaaaacacctgggaattctggggctgggctccgctctcagagctccccaagagagatcgtgacgcagctaaatcgagcaccggtcgtgtatatactgttctgatggcgcgagggaggcgatacg

SEQ ID NO: 793156 - DNA, 694 bp, Homo sapiens
  misc_feature: 63744.44.27.C05.1.pb.heavy.1.raw 63744
ctatgcgccttgccagcccgctcagacagtatataggaagtagtccttgaccaggcagccaggccgctgtgctctcggaggtgctcctggagcagggcgccaggggaagaccgatgggccttggtggaggccgagagacggtgaccaggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactcagcccctcgcctggagcctggcggacccactgcatattccaattatcgaaggtgaatccagaggctgcacaggagagtctcagggacccccctactgggccacgcctcccccagactcacgattgcacctgacacatgacacctcttaagagggcaacgaggaaaacccagctcagcccaaactccatggtgagtcctctgtgttcagtgatgatcaccgagtggaaacaccggcgacttccagtgctggctcgtctcccagggctcccaaacccttcgatcgcgtctaaatcgagcaccggtcgtgtatatactgtctgatggcgcgaggaggcgatacg

SEQ ID NO: 793157 - DNA, 707 bp, Homo sapiens
  misc_feature: 63754.44.27.C05.1.pb.heavy.1.raw 63754
cgtatcgcctccctcgcgccatcagacagtatatacacgaccggtgctcgatttagacgcgatcgaagggtttggggctgggagacgagcccagcactggaagtcgccggtgttttccactcggtgatcatcactgaacacagaggactcaccatggagtttgggctgagctgggttttcctcgttgccctcttaagaggtgtcatgtgtcaggtgcaattcgtgggagtctgggggaggcgtggccccagtagggggtccctgagactctcctgtggcagcctctggattcacttcgataattggaatatgcagtgggtccgccaggctccaggcgaggggctggagtgggtggcaggtgtgtcatttcatggaggaaatcaagtctacggtgattccgttgagggcgattcaccatctccagaggacaattccgagaacacagtgtctcttcaaatgaacagcctgagacctcaggacacggccgtgtatttttgtgcgagactatctgtttccaaaatcggttcatttcgacgcctggggccagggaaccctggtcaccgtctcctcggcctccaccaagggcccatcggtcttccccctggcgccctgctccaggagcacctccgagagcacagcggccctgggctgcctggtcaagggactacttcctatatactgtctgagcgggctggcaaggcgcatag

SEQ ID NO: 793158 - DNA, 686 bp, Homo sapiens
  misc_feature: 63757.44.35.D02.1.pb.heavy.1.raw 63757
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagaatggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcatctataacagtgggcagcaccaactacaaccccgccctcaagagtcggagtcaccatgtcactagacaggttccaagaaccagttctccctgaaattgacttctgtgaccgccgcggacacggccgtatattattgtgcgagagattcctatcgatacagtagagacgggggggcgaactggctcgaccccctggggccagggaaccctggtcaccgtctcctcagcctccaccaagggccccatcggtcttccccctggcaccctcctccaagagcacctctggggggcacagcggccctgggctgcctggtcaaggactacttcctatatactgtctgagcggcgctggcaaggcgcatag

SEQ ID NO: 793159 - DNA, 709 bp, Homo sapiens
  misc_feature: 63780.44.55.E11.1.pb.heavy.1.raw 63780
cgtatcgcctccctcgcgccatcagacagtatatacacgaccggtgctcgattttagcactcgcacgttgggtttggggagaggagcccagcactgggattcgaggtgtctttccattcggtgatcagcactgaacacagaggactcaccatggagtttttggctgagctgggcttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtggggtctcagtcatttatactggtgatttcacatactacgcagactcgtgaagggccgattcaccatctccagggacaattccaggaacacggtttatcttcaaatgaacaacctgagaggcgacgacacggccgtctattactgtgcgagacaagtcggccgctcggagtggttattattcgtttgacttctggggccagggaaccctggtcaccgtcgcctccgcctccaccaagggcccatcggtcttcccccctggcacccgcctcaagagcacctctgggggcacagcggccctgggctgcctggtcaaggactacttcctataatactgtctgagcgggctggcaaggcgcataga

SEQ ID NO: 793160 - DNA, 722 bp, Homo sapiens
  misc_feature: 63783.44.85.H08.1.pb.heavy.1.raw 63783
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtgtccagcctgggaggtccctgagactctcctgtgcagcgtctggattcaccttcagtacctatggcatgcactgggtccgccaggctccaggcaaggggcctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793161 - DNA, 607 bp, Homo sapiens
  misc_feature: 63816.UNK.UNK.UNK.pb.heavy.1.raw 63816
cccgacacgcttgctagggacttggagctaaggacgacatattgcctttagacagtcgaagtgacgccttagctaccactgaacgtttaggcgccagatgcgtctgggatgacctaactcgcagcttatcgatgatctactgcacgccaaccaccaggtcttgatgcgcgcgataggactgacgggatcgctacagacatttaactcgctagtaacttaattgagatcctagggatgggataggaaatagaatccacccctatcaccccgccccacatagccctgcttgggggtgttgagtttacttttatttcgtgttggaatgagttgaacttccgggaagtggagtaatgggtttgtctacttcccctaaccgcaaagtatagttttacgagtggcgttgcaagccatagcccagtcacaggtaataaacaattcaacgtggcgtaaagattggccgcttgctgtgggcattgcaagctggttttgcaggcattgtggcatgctagacgacaatatgaatctgcgggacccctagtggccaagatggccgctagcgggttccgcagcttttgacctggaccagggtgcatagctgccagccttc

SEQ ID NO: 793162 - DNA, 709 bp, Homo sapiens
  misc_feature: 63847.UNK.UNK.UNK.pb.heavy.1.raw 63847
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggtttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggaccccagtccatatagtggtcactgatggtgaatccagaggcgacacaggagagtctcagggaccctccaggctggaccaagtctcccccggactccaccaactgcacttcactctggacaccttgtaaaataacaacaaggaaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccgggtcgtgtatatactgtctgatggcgcgagggaggcgatacg

SEQ ID NO: 793163 - DNA, 655 bp, Homo sapiens
  misc_feature: 63901.44.23.C01.1.pb.heavy.1.raw 63901
ctatgcgccttgccagcccgctcagacagtatataggaagtagtccttgaccaggcagcccagggccgctgtgccccagaggtgctcctggagcagggcgccaggggaagacgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaaagcatccccaatcccctaaatcacgtgtactaaatcgagcaccggtcgtgtatatactgtctgatggcgcgagggaggcgatacg

SEQ ID NO: 793164 - DNA, 631 bp, Homo sapiens
  misc_feature: 63926.44.23.C01.1.pb.heavy.1.raw 63926
cgtatcgcctccctcgcgccatcagaacagtaaataaacacgaccggtgctcgattttagtacacgtgattagggattggggcagggtgaaacacctgtggttttttcctcctgctggtggcagctcccagatgggtcctgtcccaggtggcagctgcaggagtcggggcccaggactggtgaggccttcgggaaaccctgtctctcaatctgcactgtctctggagtttccatcagttctgatcattcttggggctggatccggcagcccccagggaggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgttttattttctgtgcgaggcgagactggtctttcaatctatggggccgtggcaccctggtcactgtctcctcagcttccaccaagggcccatcggtcttccccctggcgccctgctccggagcacctctgggggcacagcggccctgggctgcctggtcaaggactactttcctatatactgtctgagcggctggcaaggcgcatag

SEQ ID NO: 793165 - DNA, 566 bp, Homo sapiens
  misc_feature: 63937.44.78.H01.1.pb.heavy.1.raw 63937
cgtatcgcctccctcgcgccatcagacagtatatacacgaccggtgctcgatttagtgtgagtagtttgggtttgggtgccgaagttgctggaggtcacggtcaccacgctgctgaggtgaagaagcctgggcctcagtgacagtctcctgcacggcttctggatacacgttcatcaattatgatattaactgggtgcgacaggccgctggacaagggctggagtggatgggatgatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcgtcttcccctggcgccctgctccaggagcacctccgagagcacagcggcctggctgcctggtcaaggactacttcctatatactgtctgagcggctggcaaggcgcatag

SEQ ID NO: 793166 - DNA, 589 bp, Homo sapiens
  misc_feature: 63938.UNK.UNK.UNK.pb.heavy.1.raw 63938
ccgacacgcttgctagggactggagctaaggacgacatattgcctttagacagtcgaaggtgacgccttagctaccaactgaacgttaggcgccagatgcggtctgggatgacctaactcgcagctatcgatgacttactacacgctcaacccaaccagtcttgatgcgcgcgataggactgacggatcgctacagacattaactcgctagtaacttaattgagatcctaggggatggataggaaatagaatccacccctatcaccccccacatagcctgcttgggtgttgagtttactttattcgtgttggatgagttgaacttccggaagtggagtaatgggtttgtctacttcccctaaccgcaaagtactagttttaccgagtgcgttgcaagcctagcccagtcacagtaataaacaattcacgtggcgtaagattgggccgctgctgtggccattgcaagctgggtttgcagcatgtgcatgctagacgacaatatgaatctgcgggaccctagtggccaagatggccgctagcggttccgcagcttttgacctggaccagggtgcatagcctgcccagcgct

SEQ ID NO: 793167 - DNA, 619 bp, Homo sapiens
  misc_feature: 63966.UNK.UNK.UNK.pb.heavy.1.raw 63966
ctatgcgccttgccagcccgctagacagtatataggaagtagtccttgaccaggcagccagggccgctgtgccccagaggtgctcctggagcagggcgccagggggaagaccgatgggcccttggtggaagctgaggagacagtgaccagggtgccacggccccatgattgaaagaccagtctcgcctgcacagaaataaacggccgtgtccgcggcggtcacggggtcggtttcaggggaagcggttcatggacgtgccctcgaatggggacgactctgagggcggagtagtacgtcgccccagtataatggatgtcaccaatcactccattccctcctggggctgcggatccagcccagaatgatcagaactgatggaaaccagagacagtgcagatgagacagggttcccgaaggcctcaccagtcctggcccgactcctgcagctgcacctgggacggaccatctgggagctgccaccagcaggaggaaaaccacaggtgcttcatgttctgcacaggggggtccttgactctcagaaagccccatccctaatacgtgtactaaatcgagcaccggtcgtgtatatactgtctgatgccgcgaggaggcgatacg

SEQ ID NO: 793168 - DNA, 654 bp, Homo sapiens
  misc_feature: 63980.44.86.H09.1.pb.heavy.1.raw 63980
ctatgcgccttgccagcccgctcagacagtatataggaagtagtccttgaccaggcagcccagggccgctgtgcccccagaggtgctcctggagcagggcgccagggggaagaccgatggcccttggtggagctgaggagacagtgaccagggtgcacggccccatagattgaaagaccagtctcgcctcgcacagaaataaacggccgtgtccgcggcgggtcacggaggtcagtttcagggagaagcggttcatggacgttgccctcgaaaatggtgagacgactctttgagggacggagagtagtacgtcgccccagtattaatggatgtcaccaatccactccattccctccctggggctgccggatccagccccaagaaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaagcatccccaacccaagtctatagcactaaatcgagcaccggtcgtgtatatactgtctgatggcgcgagggaggcgatacg

SEQ ID NO: 793169 - DNA, 687 bp, Homo sapiens
  misc_feature: 64003.UNK.UNK.UNK.pb.heavy.1.raw 64003
ctatgcgccttgccgccccctccagcagtaataaggagtatccttgaccaggcgcagggccgctgtgcctcggagtgctcctgacaggcgccacgaagaccgatgggcccttgtggaggctgaggagacggtgaccagggtctccctggccccagtggacagttcctgaataaacacaacacaataatacatgccgtgtcctcggttttcaggttagtcattcgcagaatcaatgagttcttgaagtcatctcttgagaggtgatctggctttcacagacggcggcgtactctgtgataaagctggcacttgtttttaactgcgccaagccactccagccttccctggagcctggcggacccgaaagtccatatagtggtcactgatggtgaatccagagcgacagcaggagagtctcagggacccctccaggctgaccaagtctcccccggactccaccaaactgcacttcactctggaccttccgctgtaaaatacaacaaaaggaaacccagctcagcccggaactccatggtgagtcctctgtgttcagtgctgatcaccaaatgaaaacacctggaattctggggctggggctccgctcgtccccccaagagagatcgtgacgcagctaaatcgagcacccggtcgtgtatatactgtctgatggcgcgaggaggcgatacg

SEQ ID NO: 793170 - DNA, 645 bp, Homo sapiens
  misc_feature: 64030.44.86.H09.1.pb.heavy.1.raw 64030
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatggtcctgtcccaggtgcagctgcaggagtcgggccaggactggtgaggccttcgggaaccctgtctctcatctgcactgtctctggagtttccatcagttctgatcattcttgggctggatccggcagcccccagggagggaatggagtggattggtgacatccattatactggggcgacgtactactctccgtccctcaagagtcgtctcaccatttcgaggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctcaggagcacctctggggcacagcgcctgggctgcctggtcaaggactacttcctatatactgtctgagcgggctggcaaggcgcatag

SEQ ID NO: 793171 - DNA, 698 bp, Homo sapiens
  misc_feature: 64074.UNK.UNK.UNK.pb.heavy.1.raw 64074
cgtatcgcctccctcgcgccatcagacagtatatacacgaccggtgctcgatttagctgcggtcacgatctctcttggggggagagcggaagccccagccccagaattcccaggtgttttcatttggtgatcagcactgaacacagaggactcaccatggagttccgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaagggggctggagtggcttggccgcagtaaaaacaaagttgccagctttatcacagagtacggccgcgtctgtgaaagccagatcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctgggcgccctgctccaggagcacctcgagagcacagcggccctgggctgcctggtcaaggactacttgccttatactgtctgagcgggctggcaaggcgc

SEQ ID NO: 793172 - DNA, 701 bp, Homo sapiens
  misc_feature: 64076.44.55.E11.1.pb.heavy.1.raw 64076
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggcccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggccatcggtcttccccctggcaccctcctccaagagcacctctggggcacagcggccctgggctgcctggtcaaggactacttcctatatactgtctgagcgggctggcaaggcgcatag

SEQ ID NO: 793173 - DNA, 669 bp, Homo sapiens
  misc_feature: 64079.44.6.A06.1.pb.heavy.1.raw 64079
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctggcacgcctctggaagtactaccagttccactacttataccatcaactgggtgcgccaggccctggacaaggcttgagtggatgggtggaatcatccctctttttggctcactcacctacgcacgagacttccggcagaattacgattaccgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccacaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793174 - DNA, 643 bp, Homo sapiens
  misc_feature: 64082.UNK.UNK.UNK.pb.heavy.1.raw 64082
cgtatcgccctccccgcgccatcagacagtaatacacgaccggtgctcgatttagaggagtgggttagctctggccgaggagccccagcctgggatcccaggcgtcattcgtgaccaggaccgaacacgggaccccatgggtttgggcgagctggattccttgcgctatttaaaggtgtccagtgtgaggtgcgtggtgggcgggggggtttggtaaagccgggggagtcccttagacctccctgtgcagcctctggttccctcagtaacgccctggagacctgggtccgccaggctccagggaggggctggagtgggttggccggatagaaccaaagctgcgggggacagcagactacgcctgcaccccgtgaaaggcagattcaccatctcaagagatgattcaaaagatacggtgtctctgcagatgaacgcccgacaccgaggacacagcccgtctacctggtcggatggttcatcgggccagggaaccctggtcaccgtctcctcagccccaccaggcccatcggtctcccccccgggcgcctgctgccaggagcacctccgaggccacagcggccctggctgccggtcaaggactacttccctataactgtctgagcgggctggcaagggcgcatag

SEQ ID NO: 793175 - DNA, 717 bp, Homo sapiens
  misc_feature: 64087.44.85.H08.1.pb.heavy.1.raw 64087
ctatgcgccttgccagcccgctcagacagtatataggaagtagtccttgaccaggcagcccagggccgctgtgccccagaggtgctcttggagagggtgccagggggaagacgatgggcccttggtggaggctgaggagacggtgaccgtggtccttggcccagagcgtccataccgtccagtagtagtcccagcaggtggcgtagtactacaatatgtcctcgcacagtaatacacagccgtgtcctcggctctcaggctgttcatgcagatacagcgtgttcttggaatgtctctggagatggtgaaatcccccttcacgggtctgcatagtatttattacttccatcatacgcatataagtgccacccactccagccccttgcctggagcctggcggacccagtgcatgccataggtactgaaggtgaatccagacgctgcacaggagagtctcagggacctccaggctggaccacgcctccccaagactccaccagctgcacctgacactggacacctcttaaaagagcaacgaggaaaacccagctcagcccaaactccatggtgagtcctctgtgttcagtgctgatcaccgaatggaacaccgccgacttctagtgctgggctcctctcccagagctcccgcgactgagtgatactaaatcgagcaccggtcgtgtatatactgtctgatggcgcgagggaggcgatacg

SEQ ID NO: 793176 - DNA, 685 bp, Homo sapiens
  misc_feature: 64089.44.12.B01.1.pb.heavy.1.raw 64089
tatgccgttgccagcgctcagcccttccagcccctcagtacaggataggaagtagtccttgaccaggcagcccagggccgctgtgcccccagaggtgctcttggaggaggggttgccagggggaaagaccgatgggcccttggtggaggctgaggagacggtgaccagggttccctggccccagtggtcaaagtagttggtgacgaactgcccctactctcgcacagtaatacaccgggccgtgtccggcggcggtcacagagctcagcttcagggagaactggttcttggacgtgttctactgatatggtgactcgactttgagggacggttgtagtagccgtgctcccactataatagatactcccaatccactccagcccccttccctggggcctggcggatccaggcccccagtagttaactactactgctgatggagccaccagagacagtgcaggtgagggacagggtctccgaaggcttcaccagtcctggcgccgactcctgcagctgcagctgggacaggacccatctggagccgccaccagcaggaggagaaccacaggtgcttcatgttcttgcacaggaggtccatgactctcagaaagccccccgcggatctacactactaatcgagcaccggtcgtgtatatactgtctgatggcgcgaggaggcgatacg

SEQ ID NO: 793177 - DNA, 695 bp, Homo sapiens
  misc_feature: 64091.44.36.D03.1.pb.heavy.1.raw 64091
cgtatcgcctccctcgcgccatcagacagtatatacacgaccggtgctcgattagctgcgtcacgatctctcttgggggagagcggagccccagccccagaattccaggtgttttcatttggtgatcagcactgaacacagagactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtggaccactatatggactgggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactaacctgaaaaccgaggacacggcatgtattattgtgttgtgtttatatcaggaactgtccactggggccagggaaccctggtcaccggtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 793178 - DNA, 600 bp, Homo sapiens
  misc_feature: 64101.UNK.UNK.UNK.pb.heavy.1.raw 64101
ccgacacgcttgctaggacttggagctaaggacgacatattgcctttagacagtcgaaggtgacgccttagctaccactgaacgtttaggcgccagatgcggtctggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcatgcaagctgggtttgcagcattgtgcatgctagacgacaatatgaatctgcgggacccctagtggccaagatggccgctagcgggttccgcagcttttgacctggaccagggtgcatagcctgcccagcct

SEQ ID NO: 793179 - DNA, 690 bp, Homo sapiens
  misc_feature: 64109.44.27.C05.1.pb.heavy.1.raw 64109
ctatgcgccttgccagccgctcagacagtatataggaagtagtccttgaccaggcagcccaggccgctgtgctctcggagtgctcctgagcagggcgccagggggaagaccgatgggccttgtggaggccgaggagacggtgaccagggttccctggccccaggcgtcgaatgaaccgattttggaaaacagatagtctcgcacaaaaatacacggccgtgtcctgaggtctcaggctgttcatttgaagagacactgtgttctcggaattgtctctgagatggtgaatcgccctcaacggaatcaccgtagacttgatttcctccatgaaatgacacacctgccacccactccagcccctcgcctggagcctggcgacccactgcatattccaattatcgaaggtgaatccagaggctgcacaggagagtctcagggacccccctactgggccacgcctcccccagactccacgaattgcacctgacacatgaccctcttaagagggcaacgaggaaacccagctcagccaaactccatggtgagtcctcgtgttcagtgatgatcaccgagtggaaacaccggcgacttccagtgctgggctcgctcccaggccccaaacccttcgatcgcgtctaaatcgagcaccggtcgtgtatatactgtctgatggcgcgagggagcgatacg

SEQ ID NO: 793180 - DNA, 700 bp, Homo sapiens
  misc_feature: 64115.UNK.UNK.UNK.pb.heavy.1.raw 64115
cgtatcgcctccctcgcgccatcagacagtatatacacgaccgggtgctcgatttagctgcgtcacgatctctcttgggggagagcggagccccagcccccagaattcccaggtgttttcatttggtgatcagcactgaacacagaggactcaccatggagttcggggctgagctgggttttccttgttgttattttacaaggtgtccagagtgaagtgcagttggtggagtccggggggagacttggtccagcctggagggtccctgagactctcctgtgtcgcctctggattcaccatccagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaaagaactcattgattctggcgaatgactaacctgaaaaccgaggacacgggcatgtattattgtgttgtgtttatatcaggaactgtccactgggggccagggaaccctggtcaccgtctcctcagcctccaccaagggcccatcggtcttccccctggcgccctgctccaggagcacctccgagagcacagcggccctgggctggcctggtcaaggactacttcctatatactgtctgagcgggctggcaaa

SEQ ID NO: 793181 - DNA, 711 bp, Homo sapiens
  misc_feature: 64127.UNK.UNK.UNK.pb.heavy.1.raw 64127
cgtaatcgcctccctcgcgccatcagacagtatatacacgaccggtgctcgatttagccactcgcacgtttgggtttgggggggagaggagcccgcactgggattccgaggtgtttccattcggtgatcagcactgaacacagaggactcaccatggagttttggctgagctgggtttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgatcacccatctccagggacaattccaggaacacggtttatcttcaaatggaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctctctccaagagcacctctgggggcacagcggccctgggctgcctggtcaaggactacttcctatatactgtctgagcgggctggcaaggcgcatag

SEQ ID NO: 793182 - DNA, 720 bp, Homo sapiens
  misc_feature: 64130.UNK.UNK.UNK.pb.heavy.1.raw 64130
cgtatcgcctcctcgcgcgcatcgtatatacacgaccgcggtgctcgattagctgcgtcacgatctctcttgggagctcgagagcggagccagcccagaattcccaggtgtttcatttggtgatcagcactgaacacagaggacgcaccatggagttcgggctgagctgggttttccttgttgttattttacagggtgtccagagtgaagtgcagttgtgggagtccggggagacttggtccagcctggagggtccctgagacttcctgtcggtgcgcctctggatcctcgaccacttcgtggcctgcccgcggcttccggggcggtcgcatggcctcagcggggaacgcggcaccaggggggggctggagtggcttgccgcagtaaacaagttgcagctttatcacgagagtacgcgcgcgtctgtgaaagccagattcaccctctcaagagatgactcaaaagaacctcattgattctgcgaatgactaacctgaaaaccgagacacgggccatgtattattgtgttgctgtttatatcaggaactgtccactggggccagggaaccctggtcacggtctccctcagcctccaccaagggcccatccggtcttccccctgcgcgcctgctccaggagcactccgagagcacagcgccctgggctgcctggtcaaggactacttcctatatactgtctgagcgggctggcaaggcatag

SEQ ID NO: 793183 - DNA, 692 bp, Homo sapiens
  misc_feature: 64158.UNK.UNK.UNK.pb.heavy.1.raw 64158
cgtatcgcctcctcgcgccatcagacagtatatacacgacggtgctcgatttagctctacgctcagggagctctgggagaggagcccagcactagaagtcggcggtgtttccattcggtgatcagcactgaacacgaggactcaccatggagtttggggctgagctgggttttcctcgttactcttttaagaggtgtccagtgtcagtgcacctggtggagtctgggggagcgtggtccagcctgggaggtccctgagactctcctgtgaagcctctggatttagtttcagtagttctggcatgcactggtccgcaggctccaggcaaggggccggagtggtggcagttatagcatatgatggaacttctagatattatgcaagactccgtgaagggccgatcaccatctccagagacaattccggaacactctgtacctggaaatgatcagcctgagaggcgaggactcggctctgtttactgtgcgagatcgggaagtggcagcagctattatcggcgtttcactggggccagggacactggtcaccgtctcctcagcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 793184 - DNA, 701 bp, Homo sapiens
  misc_feature: 64176.44.55.E11.1.pb.heavy.1.raw 64176
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgagtgcggctgatggagtctggaggaggcttagtccagcctggggggtcccagagactctcctgtgcagcctctggctcaccgtcagcagcaactacattgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcgtcttccccctggcaccctcctccagagcacctctgggggcacagcggccctgggctgcctggtcaaggactacttcctatatactgtctgagcggctggcaaggcgcatag

SEQ ID NO: 793185 - DNA, 704 bp, Homo sapiens
  misc_feature: 64179.UNK.UNK.UNK.pb.heavy.1.raw 64179
cgtatcgcctccctcgcgccatcagacaggaggtatatacacgaccggtgctccgatttagctgcgtcacgatctctcttggggagctctgagagcggacccagccccagaattcccaggtgttttcatttggtgatcagcactgaacacagaggacttcaaccatggagttcgggctgagctgggttttcctgttgttattttacaaggtgtccaagtgaagtgcagtggtggagtccgggggagacttggtccaacctggagcgtcctgaggactctcctgtgtcgctctggattcaccatcagtgaccactatatggaccgggtccgccaggtccagggaaaggggctggagtggcttgccgcaagtaaaaacaaagttgccagtttatacagagtaccgccgcgtctgtgaaagccagattcaccctctcaagagatgacttcaagactcattgatttgcgaatgactaacctgaaaaccgaggacacgggcatgtattattgttttgtgtttatatcaggaactgtccactggggccagggaacccctggtcaccgtctcctcagcctccaccaagggcccatcggtcttccccctggcgccctgctccaggagcacctccgagagcacagcggccctgggctgcctggtaaggactacttcctatatactgtctgagcggggctggcaaggcgcatag

SEQ ID NO: 793186 - DNA, 653 bp, Homo sapiens
  misc_feature: 64181.UNK.UNK.UNK.pb.heavy.1.raw 64181
cgtattcgcctccctccgcgccatcagacagtatatacacgacccgtgctcgatttagtgctatagacttggggtttggggatgctttctgagagtcaagactcctgtgcaagaacatgaagcacctgtggtttttcctcctggctggtggcagctccccagatgggtcctgtccaggtgcagctgcaggagtcggcccaggactggtgaggccttcgggaaccctgtctctcatctgcactgtctctggagtttccatcagttctgatcattcttggggctggatccggcagcccagggaggggaatggagtggattggtgacatcattatactgggggggcgacgtactactctccgtccctcagagtcgtctcaccatttcgaggacacgtcatgaaccgcttctccctgaaactgacctccgtgaccgcgcggacacggccgtttatttctgtggcgaggcgagactggtctttcaatctatgggccgtggccaccctggtcactgtctcctcagcttccaccaagggcccatcggtcttcccctggcgccctgctccaggagcacctctgggggcacagcggccctggctgcctggtcaaggactacttcctatatacctgtctgagcgggctggcaaaggcgcatag

SEQ ID NO: 793187 - DNA, 705 bp, Homo sapiens
  misc_feature: 64205.UNK.UNK.UNK.pb.heavy.1.raw 64205
cgtatcgcctccctcgcgccatcagacagtatacacgaccggtgctcgatttagacgcggatcgaagggtttggggaggccctgggagaccgagcccagcactggaagtcgccggtgtttccctcgtgatcatcactgaacacagaggactcaccatggagtttgggctgagctgggttttcctcgttgccctcttaagagggtgtcatgtgtcaggtgcaattcgtggagtctggggaggcgtggcccagtagggggggtccctgagactctcctgtgcagcctctggattcacctcgataattggaatatgcagtggtccgccaggctccaggcgagggctggagtgggtggcaggtgtgtcatttcatgaggagaatcaagtctacggtgattccgttgagggccgatcaccatctccagagacaattccgagaacacagtgtccttcaaatgaacagcctgagaccctcaggacacggccgtggtattttgtgcgagactatctgtttccaaaatcggttcattcgaacgcctggggcccagggaaccctgggtcacgcgtctcctcgcctccaccaagggcccatcggtcttccccctggcgccctgctccagaagcacctccgagagccagcggcccctgggcggctggtcaaggactacttcccttatactgtctgagcggctggcaaggcgcgatag

SEQ ID NO: 793188 - DNA, 568 bp, Homo sapiens
  misc_feature: 64241.44.36.D03.1.pb.heavy.1.raw 64241
cgtatcgcctccctcgcgccatcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggccctggataagggtttgaatggatggtagggagctactctggcaatggtaacacaggctatgcacagaagtttcagggcagagtcaccatgaccagggcacgtccacgagcacagcctacatggagctgagcagtcagagatctgaggacatagatgtgtactactgtggagaccggtagagacaagcaagaaagaagttcttttgactactgggggccagggaacctggtcaccgtctcctcagcctccaccagggcccatcggtcttccccctgcaccctcctccaagagcactctgggggcacagcggccctgggctgcctggtcaaggactacttcctatatactgtctgagcgggctggcaagggcggcatag

SEQ ID NO: 793189 - DNA, 681 bp, Homo sapiens
  misc_feature: 64249.44.73.G07.1.pb.heavy.1.raw 64249
ctatgcgcctgccagcccgctcagacagtatataggaagtatccttgaccaggcagcccagggccgctgtgctctcggaggtggctcctggagcagggcgccagggaagaccgatgggccctggggtggaggctgaggagacggtgaccagggttcctggcccagtgtcaagcgggaccgtctcgagggggcctcgcacaataatagacagccgtgtcctcacttgtgaggtgtacatttgcagatgcagtggtcctggaattgtctctggaggacgtgaatcggcccttctccggagtctccgtagtgttcttcaattccatcttctgaataattggccaccgcactccagcccttgcctggagccggccggacccagtgcatggcataggtcctgaagatgaatccagaggctgcacaggagagtctcagggagttcccaggctgggccgctcctcccccggactccactagctgcacctgacactggcacctcttaaaagagccaacgaggaaaacccatctcagccaaagtccatgtgagtcctctgtgttcagtgatggatcacccgaatggaaacaccggcgacttcagtgctgggcctcgtctccccctgagcgtagagctaaatcgagcaccggtcgtgtatatactgtctgatgcgcgagggaggcgatacg

SEQ ID NO: 793190 - DNA, 694 bp, Homo sapiens
  misc_feature: 64261.UNK.UNK.UNK.pb.heavy.1.raw 64261
cgtatcgcctcctcgcgccatcagacagtatatacacgacggtgctcgatttagctgcgtcacgatctctctggggagctctgagagcggagcccccagccccagaattccaggtgttttcatttggtgatcagcactgaacacagaggactcaccatggagttcgggctgagctggttttccttgttgttattttacaaggtgtcagagtgaagtgcagttggtggagtcgggggagacttggtcagcctggagggtccctgagactctcctgtgtcgcctctggattcaccatcagtgaccactatatggactgggtccgccaggctccaggaaggggctggagtgcttggcgccagtaaaacaaagttgccagctttatcacagagtacgccgcgtctgtgaaagccagattcaccctctcaagagatgacttcaagaactcattgattctgggcgaatgactaacctgaaaaccgaggacacggcatgtattatttgtgttgtgtttatatcaggaactgtcactgggccaggaagccctggtcaccgtctcctcagcctccaccaaggcccatcggtcttccccctggcggccctgctccaggagcacctccgagaggcacagcggcctgggctgcctggtcaaggactacttcctatatactgtctgagcgggctgcaaggcgcatag

SEQ ID NO: 793191 - DNA, 677 bp, Homo sapiens
  misc_feature: 64301.UNK.UNK.UNK.pb.heavy.1.raw 64301
cgtatcgcctcctcgcgcccatcagacagtatatacacgaccggtgctcgatttatgctctacgctcagaggccgctgtgctctcggccggtgtttccattccggtgatcagcactgaacacagaggactcaccatggagtttgggctgagctggtttcctcgctactcttctctaagaaggtgtccagtgtccagtgcacctggtggagtctgggggaggcgtggtcagcctggaggtccctgagactctcctgtgaagcctctggatttagtttcagtagtctggcatgcactgggtccgccagctccaggcaagggccggagtggttggcagttataggcatatggatgcgaacttctagatatatgcgactccgtgaagggaccgacttcaccatctccagagaccaattcccggacattctgtacctggaaatgatcagcctggaggcgaggactcggctctgtattctgtgcgagatcggaagtggcgccagctattatcgggcgtttcactggggccaggggacactggtcaccgtctcctcagcctcaccaagggccatcggtcttccctggcgccctgctccaggacacctccgagagcacagcggccctgggctgcctgtcaagactacttcctatatactgtctgagcggctggcaaggcgcatag

SEQ ID NO: 793192 - DNA, 646 bp, Homo sapiens
  misc_feature: 64314.UNK.UNK.UNK.pb.heavy.1.raw 64314
cgtatcgcctccctcgcgccatcagacagtatatacacgaccggtgctcgatttagtagtctcataagggaaatgctttctgagagtcaaggacctcctgtgcaagaacatgaagcacctgtggttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 793193 - DNA, 643 bp, Homo sapiens
  misc_feature: 64318.44.86.H09.1.pb.heavy.1.raw 64318
cgtatcgcctcctcgcgccatcagacagtatatacacgaccggtgctcgatttagtgctatagacttgggtttgggatgctttctgagagtcaaggacctcctgtgcaagaacatgaagcacctgtgttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggagggaatggagtggattggtgacatccattatactggggcgacgtactactctccgtcctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccatcgtcttcccctggcgccctgctccaggagcacctctgggggcacagcggccctggctgcctggtcaagactacttcctatatactgtctgagcgggctggcaaggcgcatag

SEQ ID NO: 793194 - DNA, 704 bp, Homo sapiens
  misc_feature: 64319.44.36.D03.1.pb.heavy.1.raw 64319
cgtatcgcctccctcgcgccatcagacagtatatacacgaccggtgctcgatttagctgcgtcacgatctctcttggggagctctgagagcggagccccagccccagaaattcccaggtgttttcatttggtgatcagcactgaacacagaggactcaccatggagttcggctgagctgggttttccttgttgttattttacaaaggtgtccagagtgaagtgcagttggtggagtccgggggagactggtccagcctggagggtcctgagactctcctgtgtgcctctggattcaccatcagtgaccactatatggactgggtccgccaggctccagggaaggggctggagtggcttggccgcagtaaaaaacaaagttgccagctttatcacagagtacgccgcgtctgtgaaagccagattcaccctctcaagagatgacttcaagaactcattgattctgcgaatgactaacctgaaaaccgaggacacggacatgtattattgtgttgtgtttatatcaggaactgtccactggggccagggaaccctggtcaccgtctcctcagcctccaccaagggcccatcggtctttccccctggcccctgctccaggagcacctccgagagcacagcggccctgggctgcctggtcaaggactacttcctatatactgtctgagcgggctggcaaggcgcatag

SEQ ID NO: 793195 - DNA, 719 bp, Homo sapiens
  misc_feature: 64334.44.36.D03.1.pb.heavy.1.raw 64334
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctggggttttccttgttgctattttagaaggtgtccactgtgaggtgcggctggtggagtctgggggaggcttggtacaggcgggggggtccctgagactctcctgtgcagcctctggattcatcttcagtgactatgccatgaactgggtccgccaggctccagggaaggggctggagtgggtttcatatgttaatattgctggaaagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactggggccggggaaccctggtcaccgtctcctcagcctccaccaagggcccatcggtcttccccctggcgccctgctccaggagcacctccgagagcacagcgggccctgggctgcctggtcaaggactacttgcctatatactgtctgagggcgggctggcaaggcgcatag

SEQ ID NO: 793196 - DNA, 572 bp, Homo sapiens
  misc_feature: 64344.44.73.G07.1.pb.heavy.1.raw 64344
cccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatacg

SEQ ID NO: 793197 - DNA, 565 bp, Homo sapiens
  misc_feature: 64349.44.57.F02.1.pb.heavy.1.raw 64349
ctatgcgccttgccagcccgctcagacagtatataggaagtagtccttgaccaggcagcccagggccgctgtgctctcggaggtgctcctggagcagggcgccaggggggaagacgatgggcccttggtggaggctgaggagacggtgaccatggtccttcgccccagacgtccatgtatagtaatagaggtagttaccgtagtcattcccccttcctctcgcacaataatatacaagccgtgtcttcagatctcaggctgctcagctccatgtaggctgtgctcgcggatgtgtcgctggtaatggtgactctgccctggaacttctgtgaatatcttgtgtcaccattgccagcgttgatccatcccatccactcaagcctttgtccgggggcctggcgcacccactgcatagcataaatattgaaggtgtatccagaagccttgcaggaaaccttcactgaggccccaggcttcttcacctcagccccaaacccaactatatcgagctaaatcgagcaccggtcgtgtatatactgtctgatggcgcgagggaggcgatacg

SEQ ID NO: 793198 - DNA, 697 bp, Homo sapiens
  misc_feature: 64358.UNK.UNK.UNK.pb.heavy.1.raw 64358
cgtatcgcctcctcgcgccatcagacgttatacacgaccgtgctcgattttagcagacgtctgaacacacaaagggctggagaggagccccagccgtgagattcccaggagtttccacttggtgatcagcactgagcacagaccaccaaccatgggagtttgggctaatcttgattttccttgtagtttttttagaaggtgtccagtgcgaggggcgactggcggagtcgggggggggcttggcacagccagggcggtctctgagactctcctgtgtagtctcaggattcagtcttagtgattatcacttggctggtcgtcaggctccagggaagggcttgagtggatcactttcgtcagaatgaaacgttatgtggaagtaagagtacgccgcgtctgtgagggaagattcaccgtctcaagggatgactccaacagtgttggtcatttacaaatgagcaacctgagacccgacgacacaggcgtctattactgcgccaggcgatcctgggacgtcgatgcatttgatatttggggcaggggacaatggtcaccgtctcttcagcttccaccaagggccatcggtcttccccctggcgccctgctccaggagcacctctgggggcacagcggccctgggctgcctggtcaaggactacttcctatatactgtctgagcggctggcaaggcgcatag

SEQ ID NO: 793199 - DNA, 684 bp, Homo sapiens
  misc_feature: 64364.UNK.UNK.UNK.pb.heavy.1.raw 64364
cgtatcgcctccctcgcgccatcagacagtatatacacgaccggtgctcgatttagaagagagtgtgttgagctctgggagaggagccccagccttgggattcccaggtgttttcattcagtgatcaggactgaacacagaggactcaccatggagtttggctgagctggatttttccttgctggctattttaaaaggtgtccagtgtgaggtgcagttggtggagtctgggggaggttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 793200 - DNA, 665 bp, Homo sapiens
  misc_feature: 64381.44.12.B01.1.pb.heavy.1.raw 64381
ctatgcgccttgccagcccgctcagacagtatataggaagtagtccttgaccaggcagcccagggccgctgtgccccagaggtgctcttggaggagggtgccagggggaagaccgatgggcccttggtggaggctgaggagacggtgaccagggttccctggccccagtggtcaaagtagttggtgacgaactgcccctactctcgcacagtaatacacggccgtgtccgcggcggtcacagagctcagcttcagggagaactggttcttggacgtgtctactgatatggtgactcggactcttgagggacgggttgtagtaggtgctccccactataatagatactcccaatccactccagcccttccctggggctggcggatccagccccagtagtaactactactgctgatggagccaccagagacagtgcaggtgagggacaggggtctccgaaggcttcaccagtcctgggcccgactcctgcagctgcagctgggacaggacccatctgggagccgcaccagcaggaggaagaaccacaggtgcttcatgttcttgcacaggaggtccatgactctcagaaaagccccgcggaatctacactactaaatcgagcaccggtcgtgtatatactgtctatggcgcgaggggaggcgatacg

SEQ ID NO: 793201 - DNA, 704 bp, Homo sapiens
  misc_feature: 64393.44.27.C05.1.pb.heavy.1.raw 64393
cgtatcgcctccctcgcgccatcagaacagtatatacacgaccggtgctcgattagacgcgatcgaagggtttggggctgggagacgagcccagcactggaaagtcccgccggtgtttccactcggtgatcatcactgaacacagaggactcaccatggagtttgggctgagctgggtttttcctcgttgccctcttaagagtgttcatgtgtcaggtgcaattcgtggagtctgggggaggcgtggccccagtaggggggtccctgagactctcctgtgcagcctctggattcaccttcgataattggaatatgcagtgggtcccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgaggactatctgttccaaaatcggttcattcgacgcctgggccagggaaccctggtcaccgtctcctcggcctccaccaagggccatcgtcttccccctggcgccctgctccaggagcacctccgagagcacagcggccctgggctgcctggtcaaggactacttcctatatactgtctgagcggctggcaaggcgcatag

SEQ ID NO: 793202 - DNA, 651 bp, Homo sapiens
  misc_feature: 64446.44.45.E01.1.pb.heavy.1.raw 64446
cgtatcgctccctcgcgccatcagacagtatatacacgaccggtgctcgatttagtgagtcagtaagggaaaggggctggagaggagccagcactagaagtcggcggtgtttccattcggtgatcagcactgacacagaggactcaccatggagtttggctgagctgggtttctcgttgctctttagaggtgtccagtgtcaggtcagctggtggagtctggggaggcgtggtccagcctggacgtccctgagactctcctgtgttgcgtccgactcagttcagtgactctgccatgcactggtcgccaggctccaggcaaggggctggggtgggtggcagtcatctgtctgatgaagtaaagaatactatggaaactccgtgaagggccgattcccgtctccagagacattccaagaacaccgtgtactacaaatgaacattgagagccgagactcggctctctattattgtacgagccatcgttcactgggccaggagccctggtcaccgtctcctcagcctcaccaaggcccatcggtcttcccctggcgccctgctccaggagcacctccgagagcacagcggcctgggctgcctggtcaaggactacttcctatatactgtctgagcgggctggcaaggcgcatag

SEQ ID NO: 793203 - DNA, 686 bp, Homo sapiens
  misc_feature: 64503.44.27.C05.1.pb.heavy.1.raw 64503
cgtatcgcctcctcgcgccatcagacagtatatacacgaccggtgctcgatttagacgcgatcgaagggtttggggctgggagacgagccagcactggaagtcgccggtgtttccactcggtgatcatcactgaacacagaggactcacatggagtttgggctgagctgggttttcctcgttgccctctaagaggtgtcatgtgtcaggtgcaattcgtggagtctggggaggcgtggcccagtagggggtcctgagactctcctgtgcagcctctggattcaccttcgataattggaatatgcagtgggtccgccaggctccaggcgaggggctggagtgggtgcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtcctcggctccaccaagggcccatcggtcttccccctggcgccctgctccaggagcacctccgagagcacagcggcctgggctgcctggtcaagactacttcctatatactgtctggcggctgcaaggcgcatag

SEQ ID NO: 793204 - DNA, 704 bp, Homo sapiens
  misc_feature: 64538.44.36.D03.1.pb.heavy.1.raw 64538
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaagggctggagtggcttggcccgcagtaaaacaaagttgccagctttatcacagagtacgccgcgtctgtgaaagccagattcaccctctcaagagatgacttcaagaactcattgattctgcgaatgactaacctgaaaaccggaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793205 - DNA, 594 bp, Homo sapiens
  misc_feature: 64586.UNK.UNK.UNK.pb.heavy.1.raw 64586
cccgacacgcttgctagggacttggagctaaggacgacatattgcctttagacagtcgaaggtgacgccttagctaccactgaacgtttaggcgccagatgcggtctgggatgactaactcgcagcttatcgatgatctactgcacgcctcaaccaacaggtcttgatgcgcgcgatagactgacgggatcgctacagacatttaactcgctagtaacttaattgagatctagggatgggataggaaatagaatccaccctatcacccccccacatagcctgcttggggtgttgagtttacttttatttcgtgttgaatgagttgaacttccggaagtggagtaatggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcggaccctagtggccaagatggccgctagcgggttccgcagcttttgacctggacaggtgcatagcctgccagccttc

SEQ ID NO: 793206 - DNA, 707 bp, Homo sapiens
  misc_feature: 64597.UNK.UNK.UNK.pb.heavy.1.raw 64597
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagtttcttgaagtcatctcttgagaggggtgaatctggctttcacagacgcgggcgtactctgtgataaagctggcaactttgtttttactgcggccaagccactccagccccttccctggagcctggcggacccagtccaatatagtggtcactgatggtgatccagaggcgacacaggagagtctcaggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccgtcgtgtatatactgtctgatggcgcgcgagggaggcgatacg

SEQ ID NO: 793207 - DNA, 725 bp, Homo sapiens
  misc_feature: 64605.44.39.D06.1.pb.heavy.1.raw 64605
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgacgtcccctgccccagacatccatcaaatagtagtagtttatgattccccgaaccgtttccttggaggtccccctcgcacagtaataaacagacgtgtcgtcaactctcacgctgttcatttgcaaatacagcatattcttggaattgtctctggagatggtgaatcggcccttcacggagtctgagtaatacttctcacttccatcgtcggagatgactgccacccactccggccccttgctggagcctggcggacccagtgcaaaccaaatctatcgaatgagaacccagaggctacacaggagagtctcagggacctcccgggctggaccacgcctccccagactccaccaagtgctcctgacactggacacctcttaaaagagcaacgaggaaaacccagctcagcccaaactccatggtgagtcctctgtgttcagtgatgatcaccgaatggaaacaccggcgacttccagtgctgggctcgtctctcccccaaagaactgcgagatgtcactaaatcgagcaccggtcgtgtatatactgtctgatggcgcgagggaggcgatacg

SEQ ID NO: 793208 - DNA, 550 bp, Homo sapiens
  misc_feature: 64612.44.43.D10.1.pb.heavy.1.raw 64612
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793209 - DNA, 669 bp, Homo sapiens
  misc_feature: 64630.UNK.UNK.UNK.pb.heavy.1.raw 64630
cgtatcgctccctcgcgccatcagacagtatatacacgaccgtgctcgattagcgagacgcgcagggggagacgagccagcactgaagtcgcggtgttccattcggtgatcatcactgaacacagaggactcaccatgactttggctgagatggtttcctcgttgctcttttaagaggtgcagtgtcaggtgcagctagtggagtctggggaggagcggcccagcctgggaactcctgagactctcctgtgcagcctctggattcatcttcaggacctatgccatgcactgggtccgccaggctccaggcaagggctggagtgggtggcaattatatcagaagatggaattgaagaacactacggagactccgagagggccgattcaccgtctccagagacaattccaggaacacactgcatctgcaaatgtacaacctcacaagtgaggacacggctgtctattattgtgcgagagccccctcgagacggtcccgcttgactactggggccaggaaccctggtcaccgtctcctcagcctccaccaagggcccatcggtctttcccctggcgccctgctccaggagcacctccggagagcacagcggccctggctgcctggtcaagactacttcctatatacttctgagcggctggcaaggcgcatag

SEQ ID NO: 793210 - DNA, 724 bp, Homo sapiens
  misc_feature: 64652.44.55.E11.1.pb.heavy.1.raw 64652
ctaatgcgcccttgccagcccgctcagacagtatataggaagtagtccccttgaccaggcagccccaggggccgctgtgccccagaggtgctcttggaggagggtgcccaggggaagaccgatgggccccttggtggaggcggaggcgacggtggaccagggttccctggcccccagaagtcaaacgaataataaccactccgagcgccgacttgtctcgcacagtaatagacggccgtgtcgtccgcctctcaggttgttcatttgaagataaaccgtgttcctggaattgtccctgggaggatggtgaatcggcccttcacggagtctgcgtagtaatggtgaaatcaccagtataaatgactgagacccactccagccccttccctggaggcctggcggacccaactcatgtagttgctgctgacggtgagcccagagggcctgccacaggaagagtctctgggaccccccaggctggactaagcctcctccagactcccatcagccgcacctcacactggacaccttttaaaagtccaacaaggagaacccagctcagccaaaaactccatggtgagtcctctgtgtttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793211 - DNA, 641 bp, Homo sapiens
  misc_feature: 64667.UNK.UNK.UNK.pb.heavy.1.raw 64667
cgtatcgcctccctcgcgccatcagacagtatatacacgacggtgctcgatttagagagagtgtgttgggttggggggaagcacctgtggttcttcctcctgctggtggcggctccagatgggtcctgtctcagcgcagctgcgggagtcgggccaggactggtgaagcctttcgagaccctgtcctcacgtgcacgggtctctggtgcctccatcgacagaagtaatttctactggggctggatccgccagcccaggagaggggctgcagtggattgggagtctctattatagtgggaacacctactacaaccgtccctcaacggtcgagtcaccatatcgtggacacgtcgaggacacagttttccctgaaagtgagttctgtggccgccgccgacacggctggtctactactgtgtcagacatgggtccgcctatggcaggtcgtctcaattctactacgctggacgtctggggccaagggaccacggtcaccgtctcctcatcctcagcctccacaagggccatcggtcttcccctggcgcctgctccaggagcacctccgagagcacagcggcctgggctgcctggtcaaggactacttcctatatactgtctgagcgggctggcaaggcgcatag

SEQ ID NO: 793212 - DNA, 687 bp, Homo sapiens
  misc_feature: 64672.44.27.C05.1.pb.heavy.1.raw 64672
cgtatcgcctccctcgcgccatcagacagtatatacacgaccggtgctcgatttagacgcgatcgaagggtttgggcctggagacgagcccagcactggaagtcgccggtgtttccactcggtgatcatcactgaacacagaggactcaccatggagtttgggctgagctggttttcctcgttgccctcttaagaggtgtcatgtgtcaggtgcaattcgtggagtctggggagcgtggccccagtaggggggtcctgagactctcctgtgcagctctggattcaccttcgataattggaatatgcagtgggtccgccaggctcaggcgagggctggagtgggtggcaggtgtgtcatttcatgaggaatcaagtctacggtgatccgttgagggccgattcaccatctccagagacaattccgagaacacagtgtctcttcaaatgaacagcctgagacctcaggacacggccgtgtattttgtgcgagactatctgtttccaaaatcggttcattcgacgcctgggccagggaaccctggtcaccgtctcctcggcctccaccaagggccatcgtcttcccctggcgccctgctccaggagcacctccgagagcacagcggccctggctgcctggtcaaggactacttcctatatactgtctgagcgggctggcaaggcgcatag

SEQ ID NO: 793213 - DNA, 683 bp, Homo sapiens
  misc_feature: 64676.UNK.UNK.UNK.pb.heavy.1.raw 64676
cgtatcgcctcctcgcgcgccatcagacagtatatacacccacggtgctcgatttagtagctctatcagggggagcatcacataacaaccacattcctcctctaaagaagcccctgggagcacagctcatcaccatggactggacctggaggttcctctttgtggtggcagcagcaacaggtgtcagtccctggtgcaactggtgcagtctgggactagaatgccgcaaccttggtctcggtgacctttcctgcacggcctctggaagtactaccagtttccactacttataccatcaactgggtgcgccaggccctgacaagggcttgagtggatgggtggaatcatccctctttttggctcactcacctacgcacgagacttccgggcagattacgataccgcggacaagtccacagacacagtctccatgacaatgagttctttgaaatccgacgacacgccgtctactactgtgcgagaggtccgtacccagctcgcatggagccttgagatctggggcaggaaccctggtcattgtcacctcagcttccaccaggggcccatcggtcttccccctggcgccctgctccaggagcacctctgggggcacagcgggccctgggctgcctggtcaaggactacttctatatactgtctgagcgggctggcaaggcgcatag

SEQ ID NO: 793214 - DNA, 748 bp, Homo sapiens
  misc_feature: 64682.UNK.UNK.UNK.pb.heavy.1.raw 64682
cgtatcgcctccctcgcgccatcagaacagtatatacacgacggtgctcgatttagagtgagctcgttgggtttggggagctctgggagaggagcccgcaccagaagtcggcggtgtttccagtcggtgatcgagcaccgaacacagaggactcaccatggagtttgggctgaccttgggttttcctcgttgctcttttaagaggtgtccagtgttcaggtgaagctggtggaagtctctgggggaggcgtggtccagccttgggaggtccctgagactctcctgtgtagcgtctggattcaccttcaacagacatggcatgccactgggtccgccaggcttccaggcaagggacctggagtggtggcactttatatggctatgatggaaggtaataaatattatgtagattccgtgaagggccgattcaccatctccagagacaattcgaaagaacacactaatatctggaaattgaatagcctgagagccgaggacacggcttggtctactactgtgcggagagatggggctcgtggatacagatatgacatgctctactccaatggtatggacgcctgggccaagggaccacggtcgccgtcttcctcagcctccaccaagggcccatcggtcttcccctggcaccccctcctccaagagcacctctgggggcacagcggccctgggctgcctggtcaaggactacttcctatatactgtctgagcgggctggcaaggcgcatag

SEQ ID NO: 793215 - DNA, 741 bp, Homo sapiens
  misc_feature: 64695.UNK.UNK.UNK.pb.heavy.1.raw 64695
cgtatcgcctccctcgcgccgcatggcagccgggggcggtatatacgccgattcgacgtttggctcgggcgtgctcgatttagcactcgcaccgcgttgggtttgggggagagagccagcactgggattccgaggtgtttccattcggtgatcagcactgaacacaggaggactcaccatggattttggctgagctgggttctccttgttggacttttaaaaggtgtccagtgtgaggtgcggctgatggagtctggaggaggcttagtccagcctggggggggtcccagagactctcctgtgcagcctctggcgctcaccgtcagcagcaactacccatgagttgggtccgccaggctccagggaaggggctgggagtgggtctcagtcatttatactggtgatttcaacatactacgcagactccgtgaagggcccgattcaccatctccagggacaattccaggaacacggttttatcttcaaatgaacaacctgagagcgacgacacggccgtctattactgtgcgagacaagtcggcgctcggagtggttattattcgtttgacttctgggccagggaaccctgtcaccgtcgcctccgcctccaccaagggcccatcggttcttcccctggcaccctccctccaagagcaccctctgggggcacagcggcctgggctgcctggtcaaggactacttcctatatacctgtctgagcggggctggcaaggcgcatag

SEQ ID NO: 793216 - DNA, 705 bp, Homo sapiens
  misc_feature: 64698.44.36.D03.1.pb.heavy.1.raw 64698
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagggttccccggcccagtagtcaaaaccagccactgaccagtggcccgatctctcgaacagaagtagacagccgtgtctcgtctctcaggctgttcatttccagatacagtgagttcttggcattgtccctggaattggtgaatcggcccttcacagagtctggcgtagtaggtggtatctcagcaatattaacatatgaaacccactccagccccttccctggagcctggcggacccagttcatggcatagtcactgaagatgaatccagaggctgcacaggagagtctcagggacccccccccgctgtaccaagcctccccagactccacagccgcacctcacagtggacaccttctaaaatagcaacaaggaaaacccagcgcagcccaactccatggtgagtcctctgtgttcattgctgatcaccagtggaaatgccttggaatccagggctaaggccacctctctgagagctcccaagaggatcgtgacgcagctaaatcgagcaccggtcgtgtatatactgtctgatggcgcgagggaggcgatacg

SEQ ID NO: 793217 - DNA, 713 bp, Homo sapiens
  misc_feature: 64748.44.85.H08.1.pb.heavy.1.raw 64748
agcccgctcagacagtatataggaagtagtccttgaccaggcagccagggccgctgtgccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgccagatacagcgtgttcttggaattgtctctggagatggtgatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctccaggctggaccacgccctccccccagactccaccagctggcacctgacactggacacctcttaaaagagcaacgaggaaaacccagctcagccccaaactccatggtgagtcctctgtgttcagtgctgatcaccggaatggaaacaccgccgacttctagtgctgggctcctctcccagagctccccgcgactgagtgatactaaatcgagcaccggtcgtgttatcatactgtctgatggcgcgagggaggcgatacg

SEQ ID NO: 793218 - DNA, 703 bp, Homo sapiens
  misc_feature: 64751.44.27.C05.1.pb.heavy.1.raw 64751
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacgccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctggctcgtctcccaggccccaaacccttcgatcgcgtctaaatcgagcaccggtcgtgtatatactgtctgatggcgcgagggaggcgatacg

SEQ ID NO: 793219 - DNA, 638 bp, Homo sapiens
  misc_feature: 64753.UNK.UNK.UNK.pb.heavy.1.raw 64753
cgtatcgcctccctcgcgccatcagtctatactatcacgaccgtgctcgatttagagagagtgtgttgggtttggggaagcactgtggttcttctcctgctggtggcggctcccagatggtcctgtctcagccgcagctgcgggagtcggcccaggactggtgaagccttcgagaccctgtccctcacgtgcacggtctctggtgcctccatcgacagaagtaattctactgggctggatccgccagccccaggagaggggctgccagtggattgggagtctctattatagtggaacacctactacaacccgtccctcaacggtcgagtcaccatatccgtggacacgtcggaggacacagttttccctgaaagtgagttctgtggccgccgccgacacggctgtctactactgtgtcagacatggtccgcctatggcaggtcgtctcaattctactacgcttgggacgtctgggccaaggaccacggtcaccgtctcctcatcctcagcctccaccaagggcccatcgtcttccctggcgccctgctccagagcacctccgagagcacagcggccctgggctgcctgtcaaggactacttcctatatactgtctgagcgggctggcaaggcgcatag

SEQ ID NO: 793220 - DNA, 689 bp, Homo sapiens
  misc_feature: 64774.UNK.UNK.UNK.pb.heavy.1.raw 64774
cgtatcgcctccctcgcgccatcagacagtatataccacgaccggtgctcgattttgatcacataacaaccacactcctcctctaaagaagccctgggagcacagctcatcaccatggactggacctggcggttcctctttgtggtggcagcagctacaggtgtccagtcccaggtgcagctggtgcagtctggggctgaggtgaaagaagcctgggtcctcggtgaaggtctcctgcaaggcttctggaggcaccttcttcagctatgcttttatttgggtgcgacaggcccctggacaaggcttgagtggctgggagggatcatccctatctttgggcatcgaattacgcacagaagtttcaggacagagtcaccattaccgcggacgaatccacgagtacagcctacatggagctgagcaggctgagatctgaagaacacggccatctatttctgtgcgagagccctcgtcaacttcatagtccctctcatagtccacacatggaaattggttcgacccctggggccagggaaccctggtcaccgtctcctcagctccacaagggcccatcggtcttccccctggcgccctgctccaggagcacctctggggcacagcggccctgggctgcctggtcaaggactacttcctatatactgtctgagcgggcggcaaaggcgcaatag

SEQ ID NO: 793221 - DNA, 686 bp, Homo sapiens
  misc_feature: 64783.44.85.H08.1.pb.heavy.1.raw 64783
cgtatcgcctccctcgcgccatcagacagttatacacgaccggtgctcgatttagtatcactcagtcgcgggagctctgggagaggagcccagcactagaagtcggcggtgtttccattcggtgatcagcactgaacacagaggactcaccatggagtttgggctgagctgggtttcctcgtgctcttttaagaggtgttccagtgtcaggtgcagctgtggaggtctggggaggcgtggtccagctgggggtcctgagctctgtgcagcctggatcaccttcagaccatggctgcacggtccgccggctcaggaaaggggctggagtggtggcactaatggatgatggaagtaataaatacatgcagactcggaagggccgattcaccatctccagagacaattccaagaacacgctgtctgcaatgaacagcctggagccgagacacggctgtgtattactggcgaggacatattgtagtacaccacctgctggactactactacggtatggacgtctggggccaagggaccacggtcaccgtctcctcagcctccaccagggcccatcggtcttcccccctggcaccctcctccaaaagagcacctctggggcacagcggcctgggctgcctggtcaaggactactcctatatactgtctgagcgggctggcaaggcgcatag

SEQ ID NO: 793222 - DNA, 659 bp, Homo sapiens
  misc_feature: 64807.UNK.UNK.UNK.pb.heavy.1.raw 64807
ctatgcgcccttgccagcccgctcagacagtatataggaagtagtccttgaccaggcaggcccagggccgctgtgccccccagaggtgctcctgagccagggcgccagggggaagaccgatgggcccttggtggaagctgaggagacagtgaccaggggtgccacggcccatagattgaaagaccagtctcgcctcgcacagaaataaacggccgtgtccgccggcggtcacggaggtcagtttcagggagaagcggttcatggacgtgtccctcgaaatggtgagacgactcttgagggacggagagtagtacgtcgcccccagtataatggatgtcaccaatccactccattcccctccctggggggctgccggatccagccccaagaatgatcagaactgatggaaactcccagagacagtgcagatgagagacagggttcccgaaggcctcaccagtcctgggcccgactcctgcagctgcacctgggacaggaccatctgggagctgccaccagcaggaggaaaaacccacagtgcttcatgttcttgcacaggaggtccttgactctcagaaagcccccaatccctaatcacgtgtactaaatcgagcaccgcgtcgtgtatatactgtctgatggcgcgaggaggcgatacg

SEQ ID NO: 793223 - DNA, 608 bp, Homo sapiens
  misc_feature: 64819.UNK.UNK.UNK.pb.heavy.1.raw 64819
agctgggcaggctatgcaccctggtcaggtcaaaagcttgcggaacccgctagcggccatcttggccactaggggtcccgcagattcatattgtcgtctagcatgcaaaatgctgcaaacccagcttgcaatgccacagcaagcgcccaatctttacgccacgttgaattgtttattacctgtgactggctattgcttgcaacgccactcgtaaaactagtactttgcggtaggggaagtaacaaacccattactccactttcccggaagtttcaactcattccaacacgaaataaaagtaaactcacaccccaagcaggctaatgtgggggggtgataggggtggattctatttcctatcccaatcccctaggatctcaattaagttactagcgagttaaatgtctgtagcgatccgtcagtcctatcgcgcgcattcagacctggttggttgagcgttgcagtagatcatcgataagctgcggagttaggtcatcccagaccgcatctggcggcctaaacgttcagtggtagctaaggcgtcaccttcgactgtctaaaggcaatatgtcgtccttagctccaagtcccctagcaagcgtgtcggg

SEQ ID NO: 793224 - DNA, 688 bp, Homo sapiens
  misc_feature: 64835.UNK.UNK.UNK.pb.heavy.1.raw 64835
ctatgcgccttgccagcccgctcagacagtatataggaagtagtccttgaccaggcagcccaggccgctgtgcccagaggtgctcttggaggaggtgccagggaagaccgatgggccttggtggaggcggagcgacggtgaccagggttcctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacgagtctgcgtagtatgtgaaaatcaccagtataaatgactgagaccactcagccccttcccctggagcctggcggaccaactcatgtagttgctgctgacggtgagccagagctgcacaggagagtctctgggcccccaggctggactaagcctcctccagactccatcagcgcacctcacactggacaccttttaaaagtccaacaaggagaacccagctcagccaaaactccatggtgagtcctctgtgttcagtgctgatcaaccgaatggaaacaccctcggaaatcccagtgctgggctcctctccccaacccaacgtgcgagtgctaaatcgagcaccggtccgtgtatatactgtctgatggcggcgaggagcgatacg

SEQ ID NO: 793225 - DNA, 655 bp, Homo sapiens
  misc_feature: 64849.44.23.C01.1.pb.heavy.1.raw 64849
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtggcttcatgttcttgcacaggaggtccttgactcttcagaaagcccccaatccctaatcacgtgtactaaatcgagcaccggtcgtgtatatactgtctgatggcgcgagggaggcgatacg

SEQ ID NO: 793226 - DNA, 668 bp, Homo sapiens
  misc_feature: 64862.44.6.A06.1.pb.heavy.1.raw 64862
cgtatcgcctcctcgcgccatcagacagtatatacacgaccggtgctcgatttagatctactgacaaccacattcctcctctaaagaagcccctgggagcacagctcatcaccatggactggacctggaggttcctctttgtgtggcagcagcaacaggtgtccagtcctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgttaccccagctcgcatggagcctttgagatctgggggcagggaaccctggtcattgtcacctcagcttccaccaaggcccatcggtcttcccctggcgccctgctccaggagcacctctggggcacagcggcctgggctgcctggtcaagactacttccctatatactgtctgagcgggctggcaggcgcatag

SEQ ID NO: 793227 - DNA, 601 bp, Homo sapiens
  misc_feature: 64890.UNK.UNK.UNK.pb.heavy.1.raw 64890
gaggctgggcaggctatgaccctggtccaggtccagctcggaacccgctagcggccatcttggccactaggggtcccgcagattcatattgtcgtctagcatgcacaatgctgcaaacccagcttgcaatgcccacagcaagcggccaatctttttacgccacgttgaaattgtttattacctgtgactggctatggcttgcacgccactcgtaaaactagttactttgcggttaggggaattagacaaacccattacttccacttcccggaagttcaactcattccaacacgaaataaaagtaaactcaacacccaagcagcgctttatggggggggtgaaggggtggattctatttcctatcccatccctaggatctcattaagtactagcgagtaaatgtctgtagcgatcccgtcagtccctatcgcgcgcatcaagacctggtggtgagcgtgcagtagatcatcgatagctgcgagttaggtcatcccagaccgcatctggcgcctaaacgttcaggggtagctaaggcgtcaccttcgactgtctaaaggcaatatgtcgtccttagctccaagtccctagcaggcgtgtcggg

SEQ ID NO: 793228 - DNA, 668 bp, Homo sapiens
  misc_feature: 64907.UNK.UNK.UNK.pb.heavy.1.raw 64907
ctatgcgcctgccagcccgctcagacagtatataggaagtagtccttgaccaggcagcccagggccgctgtgcccccagaggtgctcttggaggagggtgccagggggaagacgatggcccttggtggaggctgaggagacggtgaccagggttccctggccccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgaggacagggtctccgaaggcttcacccgtcctgggcccgactcctgcagctgcacctcggacacgacccatctgggaggtgccaccaggaggaggaagaaccacagtgtttcatgttcttgtgcaggaggccatgagtctcagaaagtatccccaaacccaactatcgtgtgctaaatcgagcaccgtcgtgtatctgtctgatggcgcgagggaggcgatacg

SEQ ID NO: 793229 - DNA, 686 bp, Homo sapiens
  misc_feature: 64909.44.73.G07.1.pb.heavy.1.raw 64909
cgtatcgcccctcgtccgcgccatcagacagtatatacacgaccggtgctcgatttagctctacgctcagggggggagacgagccagcactgaagtcgccggtgtttccattcggtgatcatcactgaacacagaggactcaccatggactttgggctgagatggttttcctcgttgctctttaagaggtgccagtgtcaggtgcagctagtggagtctggggaggagcggcccagcctgggaactcctgagactctcctgtgcagcctctggattcatctttcaggactatgccatgcactgggtccgccaggctccaggcaagggctggagtgggtggcaattatatcagaagatggaattgaagaacactacggagactccgagaagggccgattcaccgtctccagagacaattccaggaacacactgcatctgcccaatgtacaacctcacagtgaggacacggctgtctattattgtgcgagagccccctcgagaccggtcccgcttgactactgggggccaggcgaaccctggtcaccgtctcctcagcctccaccaagggcccatcggtctcccctggcgccctgctccaggagcacctccgagagcacagcgcccgggctgcctggtcaaggactacttcctatatactgttctgagcgggctggcaaggcgcatag

SEQ ID NO: 793230 - DNA, 568 bp, Homo sapiens
  misc_feature: 64925.UNK.UNK.UNK.pb.heavy.1.raw 64925
cgtatcgcctcctcgcgccatcagacagtatatacacgaccggtgctcgattggtgtgagtagtttgggtttgggtgccgaagttgctggaggtcacggtcaccacgctgctgaggtgaagaagcctgggcctcagtgacagtctcctgcacggcttctggatacacgttcatcaattatgatattaactgggtgcgacaggccgctggacaagggctggagtggatgggatggatgaagccctatagtggcaacacggctttgccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttgcccccgtgcgccctgctccaggagcacctccgagagcacagcggccctgggctgcctggtcaaggactacttcctataactgtctgagcgggctggcaaggcgcatag

SEQ ID NO: 793231 - DNA, 661 bp, Homo sapiens
  misc_feature: 64929.44.72.G06.1.pb.heavy.1.raw 64929
cgtatcgcctccctcgcgccatcagacagtatatacacgaccggtgctcgatttagctacgactgcaagggaaagggggaagggagccttagccctggactccagcctccactggtgatcagcactgagcacagaactcaccatgattggactgagctggtttccttgttgctattttagaagtgtccagtgtgaggtgcaactggagtctgggggaggctggtcagcctggggggtccctgaactctcctgtgcagcctctggattcacctttagtatgttattcggatgaactgggtccgcaggccccagggaaggggctggagtgggtgcccatcatgaaaagatggaactgagacacgactatgtggactctgtgagggcgattcaccattccgaggacaacgccaagaaccgctttctccaatgaacatctgaccccgtcggcggacacggcgtgtatttctgtgcgaggcggactggtgccatctatgacgctggcagcaccctggtcacgtcctcctcagctccaccaagggcccatcggtcttccccctggcgccctgctccaggagcacctctgggggcacagcggccctgggctgcctggtcaaggactacttcctattatactgtctgagcgggctggcaaggcgcatag

SEQ ID NO: 793232 - DNA, 613 bp, Homo sapiens
  misc_feature: 64935.UNK.UNK.UNK.pb.heavy.1.raw 64935
cgtatccgcctccctcgcgccatcagacagtatatacacgaccggtgctcgatttagctggcgtcaccgatctctcttgggtcttgtccccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaaccatggacctgcggacacaggcacatattactgtgcacgggtaatgcgggaaagaaacagctggtttctgtattataagtcttaccatctggacgtctggggcaaagggaccacggtcaccggtctcctcagcttccaccaagggcccatcggtcttccccctggcgccctgctccaggagcacctctgggggcacagcgccctgggctgcctggtcaaggactacttcctatatactgtctgagcgggcctggcaaggcgcatag

SEQ ID NO: 793233 - DNA, 721 bp, Homo sapiens
  misc_feature: 64940.44.67.G01.1.pb.heavy.1.raw 64940
ctatgcgccttgccagcccgctcagacagtatataggaagtagtccttgaccaggcaagcccaggggccgctgtgcccccagaggtgctcttggaggagggtgccagggggaagaccgatgggcccttggtggaggcggaggcgacggtgaccagggtccctggccccagaagtcaaacgaataataaccactcccgagcgccgacttgtctcgcacagtaatagaacggccgtgtcgtccgcctctcaggttgtttcatttgaagataaaaaccgtgttcctggaattgtccctggagaatggtgaatcggcccttcacggagtctgcgtagtatgtgaaatcaccagtagtataaatgactgagacccacttccagccccttccctggagcctggcggacccaactcatgtagttgctgctgacggtgagcccagaggctgcacaggagagtctctgggaccccccaggctggactaaagcctccctccagactcccatcagccgcacctcacactggacaccttttaaaagtccaacaaggagaaacccagcctcagccaaaactccatggtgagtcctctgtgtcagtgctgatcaccgaatggaaacacctcggaatcccagtgctgggctcctctccccccaaacccaatatgtatactctaaatcgagcaccggtcgtgtatatactgtctgatggcgcgagggaggcgatacg

SEQ ID NO: 793234 - DNA, 684 bp, Homo sapiens
  misc_feature: 64944.UNK.UNK.UNK.pb.heavy.1.raw 64944
ctatgcgccttgccagcccgctcagacagtatataggaagtagtccttgaccaggcagcccagggccgctgtgctctcggaggtgctcctgagccagggcgccagggggaagaccgatgggcccttggtggaggctgaggagacggtgaccagggctccctggccccagtagaacgatggctccgtacaataatagagagccgagtcctcggctctccaaattgttcatttgtagatacacggtgttcttggaattgttctggagacggagaatcggcccttcacggagtttccatagtattctttacttccatcagaccagatgactgccacccactccagccccttgcctggagcctggcggacccagtggcatggcagagtcactgaaactgagtccggacgcaacacaggagagtctcagggacgtcccaggctggaccaacgcctcccccagactccaccagctgaacctgacactggacacctcttaaaagagcaacgaggaaaaccccagctcagccaaactccatggtgagtcctctgtgttcagtgctgatcaccgaatggaaacaccgccgacttctagtgctgggctcctctcccagcccctttcccttactgactcactaaatcgagcacggtcgtgtatatactgtctgatggcgcgagggaggcgatacg

SEQ ID NO: 793235 - DNA, 684 bp, Homo sapiens
  misc_feature: 64956.44.73.G07.1.pb.heavy.1.raw 64956
cgtatcgcctccctcgcgccatcagacagtatatacacgaccggtgctcgatttagctctacgctcagggccgctgtgctctcggcggtgtttccattcggtgatcagcactgaacacagagactcaccatggagtttgggctgagctgggttttcctcgttactcttttaagaggtgtccagtgtcagtgcacctggtggagtctgggggaggcgtggtccagcctgggaggtccctgagactctcctgtgaagcctctggatttagtttcagtagttctggcatgcactgggtcgccaggctccaggcaaggggccggagtggttggcagttatagcatatgatggaacttctagatattatgcagactccgtgaagggccgattcaccatctccagagacaattccccggaacactctgtacctggaaatgatcagccgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtccaaggactacttcctatatactgtctggagcgggctggcaaggcgcatag

SEQ ID NO: 793236 - DNA, 738 bp, Homo sapiens
  misc_feature: 64959.UNK.UNK.UNK.pb.heavy.1.raw 64959
cgtatcgcctccctcgcgccatcagacagtatatacacgaccgggtgctcgatttagagtgagctcgttgggtttgggggagctctgggagaggagcccagcacccagaagtcggccggtgtttcagtcggtgaaattcagccaccgaacacagaggactcaccatggagtttgggctgacctgggtttttcctcgttgctcttttaagaggtgtccagtgtcaggtgaaagctggtgagtctggggaggctggtccagcctggggaggtccctgaagactctcctgtgtagcgtctggattcaccttcaacagactggcaatgcactgggtccgccaggctccaggcaagggactggagtgggtggcacttatatggtatgatggaagtaataatattatgtagattccgtgaaagggccgattcaccatctccagagacaattcgaagaacacactatatctggaaatgaatagcctgagagaagcgaggacacggctgtctactactgtgcgagagatggggctcgtggatacagatatgacatgctcactccaatggtaatggacgcctggggccaagggaccacggtcgccgtctcctcagcctccaccaagggcccatcggtcttcccctggcaccctcctccaagagcacctctgggggcacaagcggccctggctgcctggtcaaggactacttcctatatactgtctgagcgggctgcaaggcgcatag

SEQ ID NO: 793237 - DNA, 698 bp, Homo sapiens
  misc_feature: 64961.44.62.F07.1.pb.heavy.1.raw 64961
ctatgcgccttgccagcccgctcagacagtatataggaagtagtccttgaccaggcagcccagggccgctgtgctctcggaggtgctcctggagcagggcgccagggggagaccgatgggcccttggtggaggctgaagagacggtcaccactgtcccccgcccaagtactaaaggtgtcatggggggtcaccgtggtcctggctttcaaacagtaatagacgcctgtgtcctcgggtctcaggttttcatttggagaaacaattttcctgcgaattgtccctggaatggtgaagcggcccttcacggagtctccgtagaaagtgacaccaccagctcgatacttgagacccactccagtcccctccctggagcccggcggacccaggtcatgccataggcactaaggtgaatccagaggccgcacaggagagggtcagggacctcccaggccgaatcaggccccccagactccaacaactgcacttcacacacgacaccctttaaaaagccacaagaaaaaggcagctcagcccaaactccatggagacttctctctgttcgtcctggtcaccaaatgaagacacctgaaaatcccaggctgggctctctcctcagagctcccctttcctttatgcgactactaaatcgagcaccggtcgtgtattatactgtctgatggcgcgaggaggcgatacg

SEQ ID NO: 793238 - DNA, 669 bp, Homo sapiens
  misc_feature: 64973.44.38.D05.1.pb.heavy.1.raw 64973
ctatgcgccttgccagcccgctcagacagtatataggaagtagtccttgaccaggcagcccaggccgctgtgcccccagaggtgctcctggagcaggcgccagggggaagaccgatgggcccttggtggaagctgaggagacggtgaccgtggtcccttggcccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacacccagccccttccctggagcttggcggacccagtgcatccagtagctactgaaggtgaatccagaggctgcacaggagagtctcaggaccccccaggctgaactaagcctccccccatgcccacggtgcccagagccccaaatcttgtgacacacctccccgtgcccaaggtgccagcacctgaactcctgggaggaccgtcagtctcttctcttccccccaaacccaactatcagatactaaatcgagcaccggtcgtgtatatactggtctgatggcgcgaggaggcgatacg

SEQ ID NO: 793239 - DNA, 679 bp, Homo sapiens
  misc_feature: 64980.44.72.G06.1.pb.heavy.1.raw 64980
cgtatcgcctccctcgcgccatcagacagtatatacacgaccggtgctcgatttagctacgactgcaagggaaagggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggctggtccagcctgggggtccctgagactctcctggcagcctctggattcacctttagtagttattggatgaactgggtcgccaggctccaggggaagggctggagtgggtggccatcatgaagaaagatggaactgagacacactatgtggactctgtgaaggccgattcacccatctccagagacaacgccaagaactcactgtatctgcaaatgaacagtctgagagtcgaggacacggctgtgtttattgtgcggaggcgctggtggctcattgactactggggtcagggaaccctggcaccgttcctcagcctccacaagggcccatcggtcttcccctggcgccctgctccaggagcacctcgagagcacagcgccctgggctgcctggtcaaggactacttcctatatactgtctgagcgggctggcaaggcgcatag

SEQ ID NO: 793240 - DNA, 657 bp, Homo sapiens
  misc_feature: 64981.44.12.B01.1.pb.heavy.1.raw 64981
cgtatcgcctccctcgcgccatcagacagtatatacacgaccggtgctcgatttagtagtgtagattccgcggggctttctgagagtcattgacctcctgtgcaagaacatgaagcacctgtggttcttcctcctgctggtggcggctcccagatgggtcctgtccagctgcagctgcaggagtcgggccaggactggtgaagccttcggagacctgtccctcacctgcactgtctctggtggctccatcagcagtagtagttactactgggctggatccgccagcccagggaaggggctggagtggattgggagtatctattatagtgggagcacctactacaacccgtccctcaagagtcgagttcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccctggcaccctcctccaagagcacctctgggggcacagcggccctgggctgcctggtcaaggactacttcctatatactgtctgagcgggctggcaaggcgcatag

SEQ ID NO: 793241 - DNA, 723 bp, Homo sapiens
  misc_feature: 64983.44.85.H08.1.pb.heavy.1.raw 64983
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttggctgagctggtttttctcgttgctcttttaagaggtgtccagtgtcaggttgcagctggtggagtctgggggaggcgtggtccagcctgggaggtccctgagactctcctgtgcagcgtctggattcaccttcagtactatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagccttcccaccaagggccatcggtcttccccctggcaccctcctccaagagcacctctgggggcacagcgggccctgggctgcctggtcaaggactacttcctatatactgtctgagcgggctggcaaggcgcatag

SEQ ID NO: 793242 - DNA, 705 bp, Homo sapiens
  misc_feature: 64987.44.73.G07.1.pb.heavy.1.raw 64987
cgtatcgcctccctcgcgccatcagacagtatatacacgaccggtgctcgatttagctctacgctcaggggagctctggagaggagcccagcactagaagtcggcggtgtttccattcggtgatcagcactgaacacagaggactcaccatggagtttgggctgagctgggttttcctcgttactctttaaagaggtgtccagtgtcaggtgcacctggtggagtctggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggaactcggctctgtattactgtgcgagatcgggaaagtggcagcagctattatcgggcgtttcactggggccagggaccactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793243 - DNA, 660 bp, Homo sapiens
  misc_feature: 64988.44.12.B01.1.pb.heavy.1.raw 64988
cgtatcgcctccctcgcgccatcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatccagcagtagtagttactactggggctggatccgccaccccccagggaagggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccacaagggcccatcggtcttcccctggcaccctcctcaagagcacctctgggggcacagcggccctgggctgcctggtcaaggactacttcctatatatgtctgagcggctggcaaggcgcatag

SEQ ID NO: 793244 - DNA, 609 bp, Homo sapiens
  misc_feature: 64994.UNK.UNK.UNK.pb.heavy.1.raw 64994
gaaggctgggcagggctatgcaccctggtccaggtcaaaagctgcggaaccgctagcggccatcttggcccactagggtcccgcagattcatattgtcgtctagcatgcacaatgctgcaaaccagcttgcaatgcccacagcaagcggccaatctttacgccacgttgaattgtttattacctgtgactggctatggcttgcaacgccactcgtaaaactagtacttttgcggttaggggaagtagacaaaccattactccacttccggaagttcaactcattccaacacgaaataaaagtaaactcaacaccccaaagcaggctatgtgggggggtgataggggtggattctatttcctatccatcccctaggatctcaattaagttactagcgagttaaatgtctgtagcgatcccgtcagtcctatcgcgcgcatcaagacctggtttggtgagcgtgcagtagatcatcgataagctgcgagttaggtcatcccagacgcatctggcgcctaaacgttcagtgggtagctaaggcgtcaccttcgactgtctaaaaggcaatatgtcgtccttagctcccaagttcctagcaagcgtgtcgggt

SEQ ID NO: 793245 - DNA, 574 bp, Homo sapiens
  misc_feature: 65026.44.78.H01.1.pb.heavy.1.raw 65026
ctatgcgccttgccagcccgctcagacagtatataggaagtagtccttgaccaggcagcccagggccgctgtgctctcggaggtgctcctgagcagggcgccagggggaagaccgatgggcccttggtggaggctgaggagacggtgaccagggttccctggccccacaagtcaagccaggttgctggtggctctcgcacagaaatacacggccgtgtcctcagatctcagctgctcagttccatgtagactgtacctggggaggtgctcctggtcatactaactctgccttggaacttctgggcaaagcccgtgttgccactatagggcttcatccatcccatccactccagccccttgtccagcggcctgtccgcacccagttaatatcataattgatgaacgtgtatccagaagccgtgcaggagactgtcactgaggccccaggcttcttcacctcagcagcgtggtgaccgtgacctccagcaactttcggcacccaaacccaaactactcacactaatcgagcaccggtcgtgtatatactgtctgatggcgcgagggaggcgatacg

SEQ ID NO: 793246 - DNA, 642 bp, Homo sapiens
  misc_feature: 65043.UNK.UNK.UNK.pb.heavy.1.raw 65043
ctatgcgccttgccagcccgctcagacagtatataggaagtagtcctttgaccaggcagcccaggcgctgtgccccccagagtgctcctggagcagggcgccagggaagaccggatggcccttgggtgaagctgaggagacagtgaccaggtgccacggccccatagatgaaagaccagtctcgctcgcacagaaataacggccggtgtccgcgcgtcacggaggtcagtttcagggagaagcggttcatggacgtgtcctcgaaatggtgagacgatcttgagggacggagagtagtacgtcgcccagtataatggatgtcaccaatcactcattcccctccctggggctgccggatccagccccaagaatgatcagaaactgatggaaacctccagagacagtgcagatgagagacagggttcccgaaggcctcaccagtccgggcccgactcctgcagctgcacctgggacaggacccatctgggagctgccaccagcaggaggaaaaaccacaggtgcttcatgttcttgcacaggaggtccttgactctcagaaagcatcccaaacccaagtctatagcactaaatcggagcaccggtcgtgtattactcgtctgatgcgcgagggaggcggatacg

SEQ ID NO: 793247 - DNA, 662 bp, Homo sapiens
  misc_feature: 65050.UNK.UNK.UNK.pb.heavy.1.raw 65050
ctatgcgccttgccagcccgctcagacagtatataggaagtagtccttgaccaggcagccagggccgctgtgcccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggtcttggacgtgtctactgatatggtgactcgactctgagggacgggttgtagtaggtgctcccactataatagatactcccaatccactccagccccttccctgggggctggcggatccagccccagtagtaactactactgctgatggagccaccagagacagtgcaggtgagggacaggtctccgaaggcttcaccagtcctgggcccgactcctgcagctgcagctgggacagcggacccatctggagccgccaccagcaggaggaagaaccacaggtgcttcatgttcttgcacaggaggtccatgactctcagaaaggcccccgcggaatctacactactaaatcgagcacgcgtcgtgtatatactgtctgatggcgcggaggaggcgatacg

SEQ ID NO: 793248 - DNA, 634 bp, Homo sapiens
  misc_feature: 65078.44.23.C01.1.pb.heavy.1.raw 65078
ctatgcgccttgccagccgctcagacagtatatagaagtagtccttgaccaggcagcccagggccgctgtgccccagaggtgctcctggagcagggcgccaggggaagccgatgggccttggtggaagctgaggagacagtgaccgggtgccacggcatagattgaaagaccagtctcgcctcgcacagaaataaacggccgtgtccgcggcggtcacggaggtcagttcaggagaagcggttcatggacgtgtccctcgaaatggtgagacgactcttgagggacggagagtagtacgtcgccccagtataatgatgtcaccaatccactccattcccctcctggggctgccggatccagccccaagaatgatcagaactgatggaaactccagagacagtgcagatgagagacagggttccgaaggcctcaccagtcctgggcccgactcctgcagctgcacctgggacaggacccatctgggagctgccaccagcaggaggaaaaaccacaggtgcttcatgttcttgcacaggaggtccttgactctcagaagccccaatccctaatcacgtgtactaatcgagcaccggtcgtgtatatactgtctgatggcgcgagggaggcgatacg

SEQ ID NO: 793249 - DNA, 703 bp, Homo sapiens
  misc_feature: 65125.44.27.C05.1.pb.heavy.1.raw 65125
ctatgcgccttgccagcccgctcagacagtatataggaagtagtccttgaccaggcagcccagggccgctgtgctctcggaggtgctcctggagcagggcgccaggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgattcctccatgaaatgacacacctgccaccactccagcccctcgcctggagcctggcggacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaccggtcgtgtatatactgtctgatggcgcgagggaggcgatacg

SEQ ID NO: 793250 - DNA, 737 bp, Homo sapiens
  misc_feature: 65152.44.86.H09.1.pb.heavy.1.raw 65152
ctatgcgccttgccagcccgctcagacagtataataggaagtagtcctttgaccaggcagcccagggccgctgtgcccccagagtgctcttggaggagggtgccaggggaagaccgatgggcccttggtggaggctgagagacggcgaccgtggtcccttggcccaggcgtccataccattggagtagagcatgtcatatctgtatccacgagccccatctctcgcacaagtagtagacagccgtgtcctcggctctcaggctattcatttccagaatattagtgtgttcttcgaattgtctctggagatggtgaatcggcccttcacggaatctacataatatttattacttccatcataccatataagtgccacccactccagtcccttgcctggagccttgcggaccagtgcatgccatgtctgttgaaggtgaatccagacgctacacaggagagtctcaggacctcccaggctggaccacgcctccccccagactcaccaagcttcacctgacactggacacctcttaaaaaagagcaacgaggaaacccaggtcagcccaaaactccatggtgagtcctctgtgttcggtgctgatcaccgactggaaacacccgccggacttctggtgctggggctcctctcccagagctcccaaaacccaagtctatagcactaaatcgagcaccggtcgtgtgtatatactgtctgatggcgcgagggaggcgatacg

SEQ ID NO: 793251 - DNA, 652 bp, Homo sapiens
  misc_feature: 65163.UNK.UNK.UNK.pb.heavy.1.raw 65163
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctccgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctcctgggggctgccggatccagccccaagaatgatcagaactgatggaaactccagagacagtgcagatgagagacagggttcccgaaggcctcaccagtcctggcccgactcctgcagctgcacctgggacaggaccatctgggagctgccaccagcaggaggaaaaaccacaggtgcttcatgttcttgcacaggaggtccttgactctcagaagcatccccaaacccaagtctatagcactaaatcgagcacgcggtcgtgtatatactgtctgatggcgcgagggaggcgatacg

SEQ ID NO: 793252 - DNA, 691 bp, Homo sapiens
  misc_feature: 65197.44.73.G07.1.pb.heavy.1.raw 65197
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggccttctcggagtctccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatacg

SEQ ID NO: 793253 - DNA, 697 bp, Homo sapiens
  misc_feature: 65203.UNK.UNK.UNK.pb.heavy.1.raw 65203
cgtatcgcctccctcgcgccatcagacagtatatacacgaccggtgctcgatttagctggcgtcacgatctctcgttggggagagcgagccccagccccagaattcccagcgtgtttcatttggtgatcagcactgaacacagaggactcaccatggagttcgggctgagctgggttttccttgttgttattttacaaggtgtccagagtgaagtgcagttggtgagtccgggggagacttggtccagcctggagggtccctgagactctcctgtgtcgcctctggattcaccatcagtgacactatatggactgggtccgccaggctccagggaaggggctggagtggcttggccgcagtaaaaacaaagttggccagctttatcacagagtacgccgcgtctgtgaaagccagattcacgcctctcaagagatgacttcaagaactcattgattctgcgaatgactaacctgaaaacgaggacacgggcatgtattattgtgttgtgtttatatcaggaactgtccactggggccagggaacccctggtcaccgtctcctcagcctccaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 793254 - DNA, 638 bp, Homo sapiens
  misc_feature: 65205.UNK.UNK.UNK.pb.heavy.1.raw 65205
gaaggctgggcaggctatgcaccctggtccaggtcaaaagctgcggaacccgctagcggccatctttggccactaggggtcccgcagattcatattgttcgtctagcaatgcacaatgctgcaaacccagcttgcaatgcccacagcaagcggccaatctttacgcccacgttgaattgtttattacctgtgactggctatggcttgcaacgccaactcgtaaaaaactagtacttttgcgggtaggggagtagaacaaaacccattactccacttcccggaagttcaactcattccaaacacgaaataaaagtaaactcaacaccccaagcaggctatgtgggggggttgaataggggttggattctatttcctatcccaatcccctaggatctcaaattaagttactagcgagttaaatgtctgtaggcgattccgtcagtcctattcgcgcgcatcaagacctggtttggttggagcgtgcagtagatcatcgataaagctgcgagttaggtcatccccagaccgcatctggcgcctaaaacgttcagtggtagcttaaggcgtccaccttcgactgtctaaaggcaatatgtcgtccccttagctttccaagtccctagcaaagcgtggtcggg

SEQ ID NO: 793255 - DNA, 654 bp, Homo sapiens
  misc_feature: 65209.44.57.F02.1.pb.heavy.1.raw 65209
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatcccaaacccaactatatcgagctaaatcgagcaccggtcgtgtatatactgtctgatggcgcgagggaggcgatacg

SEQ ID NO: 793256 - DNA, 719 bp, Homo sapiens
  misc_feature: 65213.UNK.UNK.UNK.pb.heavy.1.raw 65213
ctatgcgccttgccagccgcgctcagacagtataggaagtagtccttgaccaggcagcccagggccgctgtgcccccagaggtgctcttggaggagggtgccagggggaagaccgatgggcccttggtggaggcggaggcgacggtgacccagggttccctggcccccagaagtcaaacgaataataaccactccgagcgccgacttgtctcgcacagtaatagacggccgcgtgtcgtcgcctctcaggttgttcatttgaagataaaaccgtgttcctggaattgtccctggagatggtgaatcggccccttcacggagtctgcgtagtatgtgaaatcaccagtataaatgactgagacccactccagccccttccctggagagcctggcggcccaactcatgtagttgctcgctgacgtgagcccagagggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccccaaaacccaacgtgcgagtggctaaatcgagcaccgggtcgtttaatactgtctgatggcgcgagggaggccgatacgag

SEQ ID NO: 793257 - DNA, 473 bp, Homo sapiens
  misc_feature: 65220.44.6.A06.1.pb.heavy.1.raw 65220
cgtatcgcctccctcgcgccatcagacagtatatacacgaccggtgctcgatttagatctactgacaaccacattcctcctctaaagaagccctgggagcacagctcatcaccatggactggacctggaggttcctctttgtggtggcagcagcaacaggtgtccagtcctggtgcaactggtgcagtctgggactagaatgcgcaaccttggtcctcggtgaccctttcctgcacggcctctggaagtactaccagttccactacttataccatcaactggtgcgccaggccctggacaagggcttgagtggatggtggaatcatccctcttttggctcactcacctacgcacgagacttccggggcagaattacgattaccgcgacaagtccacagacacagtctccatgacaatgagttctttgaaatccgacgacacggccgtctactactgtgcgagaggtccgtacc

SEQ ID NO: 793258 - DNA, 658 bp, Homo sapiens
  misc_feature: 65222.UNK.UNK.UNK.pb.heavy.1.raw 65222
cgtatcgcctcccctcgcgccatcagacagtatatacacgaccggtggctcgatttagtgctatagacttgggtttggggatgctttctgagagtcaaggaacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctcctgaaactgacctccgtgaccgcccgcggacacggccgttttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793259 - DNA, 698 bp, Homo sapiens
  misc_feature: 65223.44.67.G01.1.pb.heavy.1.raw 65223
ctatgcgccttgccagcccgctcagacagtatataggaagtagtccttgaccaggcagcccagggccgctgtgccccagaggtgctcttggaggagggtgccagggggaagaccgatggcccttggtggaggcggaggcgacggtgaccagggttccctggccccagaagtcaaacgaataataaccactccgagcgccgactgtctccacagtaatagacggccgtgtcgtcgcctctcaggttgttcatttgaagataaaccgtgttcctggaattgtccctggagatggtgatcggcccttcacggagtctgcgtagtatgtgaaatcaccagtataaatgactgagacccactccagccccttccctggagccgggcggaccaactcatgtagttgctgctgacggtgagcccagagctgcacaggaggagtctctgggaccccccaggctggactaagcctcctccagactccatcaagccgcacctcacactggacaccttttaaaagtccaacaaggagaacccagctcagccaaaactccatggtgagtcctctgtgttcagtgctgatcaccgaatggaaacacctcgaatcccagtgctgggctcctctccccccaaacccaatatgtatactctaaatcgagcaccggtcgtgtatatactgtctgatgcgcgagggaggcgatacg

SEQ ID NO: 793260 - DNA, 620 bp, Homo sapiens
  misc_feature: 65229.UNK.UNK.UNK.pb.heavy.1.raw 65229
cgtatcgcctccctcgcgccatcagacagtatatacacgacggtgctcgattagtgctatagacttgggtttggggatgcttctgagatcaaggacctcctgtgcaagacatgagcacctgtggttttcctcctgctggtgcagctcccagatgggtcctgtcccaggtgcagctgcaggagtcggccggactggtgaggccttcgggaaccctgtctctcatctgcactgtctctggagtttccatcagttctgatcattcttggggctggatcggcagcccagggagggggaatgagtggatggtgacatcattatactggggcgcgtactactctccgtccctcagagtcgtctcaccatttcgaggacacgtccatgaaccgcttctccctgaaactgacctccgtgaccgccgcgacacggccgtttattctgtgcgaggcgagactgtctttcaatctatggggccgggcaccctggcactgtctcctcgcttccacagggccatcgtcttcccctggcgccctgctccaggagcacctctggggggcacagcgcctgggctgcctggtcaagctacttcctatatactgtctgagcgggctgcaggcgcatag

SEQ ID NO: 793261 - DNA, 728 bp, Homo sapiens
  misc_feature: 65233.44.27.C05.1.pb.heavy.1.raw 65233
ctatggcgcctttgccagcccgctcagacagtatataggaagtaagtccttgaccaggcagcccagggccgctgtgctctctcggaggtgctgcctggagcaggccggccaggggaagaccgatggcccttggtggaggccgaggagacggtgaccagggttcccctggccccaggcgtcgaatgaaccgatttggaaacagatagtctcgcacaaaaatacacggccgtgtcctgaggtctcttcaggctgttcatttgaatgaggacactgtgtttctcggaattgtctctggagatggtgaatcggccctcaacggaatcaccggtagactgatttcctccatgaaatgacacacctgccacccccactccagcccctcgcctggagcctggcggacccactgcatattccaattatcgaaggtgaatccagaggctgcacaggagagtctcagggaccccccctactggggccaccgcctccccagactccacgaattgcacctgacacatgacacctcttaagagggcaacgaggaaaacccagctcagcccaaacctccattggtgagtcctctgtgttcagtgatgatcaccgagtggaaacacccggcgacttcccagtgctgggctcgtctcccaggccccaaacccttcgatcgcgtctaaatcgagcaccggtcgtgtaatatatactgtctgatggcgccggaggaggccgatacg

SEQ ID NO: 793262 - DNA, 596 bp, Homo sapiens
  misc_feature: 65255.UNK.UNK.UNK.pb.heavy.1.raw 65255
ctatgcgccttgccagcccgctcagacaataggaagtagtccttgaccaggcagcccagggccgctgtgccccagaggtgctctggagcagggcgccaggggaagaacgatgggccttggtggaagctgaggagacggtgaccgtggtccctttgccccagacgtccagatggtaagacttataatacagaaaccagctgtttctttcccgcattacccgtgcacagtaatatgtgcctgtgtccgcagggtcatgttggtcatactaaagacacctgcccttttggaggtgtccttggagatggttaaactgctcttcagagatgtactgtaggatttttcgtcattcgagaagatgtgtgcaagccactccagggccttccctggggctgacggatccagctcacaccattctaatatcgttgagagagaaccagagatggtgcaggtcagcgtgagggtctctgtgggtttcaccagcacaggaccagactccttcaaggtgacctgggacaagaccaagagagatcgtgacgcagcctaaatcgagcaccggtcgtgtatatactgtctgatggcgcgagggaggcgatacg

SEQ ID NO: 793263 - DNA, 655 bp, Homo sapiens
  misc_feature: 65260.44.86.H09.1.pb.heavy.1.raw 65260
ctatgcgcctgccagcccgcctcagaccagtatataggaagtagtccttgaccaggcagcccagggccgctgtgcccccagaggtgctcctggagcagggccgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcgcgttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaccacaggtgcttcatgttcttgcacaggaggtccttgactctcagaaagcatcccaaacccaagtctatagcactaaatcgagcaccggtcgtgtatatactgtctgatggcgcgagggaggcgatacg

SEQ ID NO: 793264 - DNA, 672 bp, Homo sapiens
  misc_feature: 65287.44.35.D02.1.pb.heavy.1.raw 65287
cgtatcgccctccctcgcgccatcagacagtatatacacgaccggtgctcgatttagcacacgatagttgggtttgggatactttctgagaccatggcctcctgcacaagaacatgaaacacctgtggttcttcctcctcctggtgcacctcccagatgggtcgtgtccgaggtgcagctgcaggagtcgggcccaggacgggtgaagccttcggagacccctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcacatgtcactagacaggtccaagaaccagttctccctgaaattgacttctgtgaccgccgcgacacggccgtatattattgtgcgagagattcctatcgatacagtagagacggggggcgaactggctcgacccctggggccagggaaccctggtcaccgtctcctcagcctccaccaggcccatcggtcctccccctgcaccctcctccaagagcacctctgggggcacagcggccctgggctgcctggtcaaggactacttcctatatactgtctgagcggggctggcaaggcgcatag

SEQ ID NO: 793265 - DNA, 665 bp, Homo sapiens
  misc_feature: 65328.44.71.G05.1.pb.heavy.1.raw 65328
cgtatcgcctccctcgcgccatcagacagtatatacacgaccggtgctcgatttagtgtcgtcgcaagagagaggggcccagccctggggactgaacagagagaactcaccatggagtttgggctgagctggctttttcttgtggctgtttaaaaggtgtccagtgtgaagtgcagctgttggagtcgggggaggcttggtacagccgggggtccctgacactctcctgtgcagcctctggattcgcctttaatacctatgccatgatctgggtccgtcaggcccagggaagggctggagtgggtctcatccattactggtggtagtgccacaaatgtcgcagactccgtgaagggccgcttcatcgtctccagggacaattcaagaatacggtgtttctgcagatgaagagcctgcgagtggacgacacggccctttattactgtgccagagggtcgcagaagttacaacaatacaagtattactactacatggacgtctggggcaaagggacccggtcaccgtctcctcagcctccaccaagggccatcggtcttcccctggcaccctcctccaagagcacctctgggggcacagcggccctgggctgcctggtcaaggactacttcctatatactgtctgagcgggctggcaaggcgcatag

SEQ ID NO: 793266 - DNA, 674 bp, Homo sapiens
  misc_feature: 65335.44.35.D02.1.pb.heavy.1.raw 65335
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattatggagttggctgcggcagtccgccgggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggcgaactggctcgacccctggggccagggaaccctggtcaccgtctcctcagcctccaccaagggcccatcggtcttccccctggcaccctcctccaagagcacctctgggggcacagcgccctggctgcctggtcaaggactacttcctatatactgtctgagcgggctggcaaggcgcatag

SEQ ID NO: 793267 - DNA, 676 bp, Homo sapiens
  misc_feature: 65362.UNK.UNK.UNK.pb.heavy.1.raw 65362
tgacagcgtatcgcctcctcgcgccatcagacagtatatacagaccggtgctcgatttagacgcgatcgaagggttttggggggaagaggaagtcgccggtgtttccactcggtgatcatcactgaacacagaggactcaccatggagttttgggctgagctgggttttcccgttgccctcttaagaggtgtcatgtgtcagtgcaattcgtggagtctgggggaggcgtggcccagtagggggtctgagactctctgggcagcctctggatcaccttcgataattggaatatgcagtgggtccgccaggctccaggccgaggggctggagtgttgggcaggtgtgtatttcattggaggaaatcaagtctacggtgattccgttgagggcgattcaccatctccagaagacaattccgagaacacagtgtctcttcaaatgaacagcctgagactcaggacacggcgtgtatttttgtgcgagactatctgtttccaaaatcggttcattcgacgccgggccagggaaccctggtcaccgtctcctcggcctcacaaggggccatcgtcttcccctggcgccctgcctcaggagcacctcgagagcacagcggcctggctgcctggtcaaggactacttccttatactgtctgagcgggctggcaaggcgcatag

SEQ ID NO: 793268 - DNA, 604 bp, Homo sapiens
  misc_feature: 65368.UNK.UNK.UNK.pb.heavy.1.raw 65368
cgtatcgcctccctccgcgcccccgccggccatcagaacagtatatatacaacgaccgggttcgatttagtggtgagtagtttcgtgggtttgggtgccgaagtgctggaggtcacgcacggtcacccacgcatgctgaggtgaaggaagcctggggccctcagtgacagtctcctggcagcggcttctggatacacgttcatcaattatgatattaacttgggttgcgacaggaccgctggacaagggctggagtggatgggatggatgaagccctatagtggcacacacgggcttttgcccagaagttccaggcagaagttagtatgaccaggagcacctccccaggtacagtctacatgaactgagcagcctgagatctgaggacacggccgtgtattctgtgcgagagcaccagcactggcttgacttgtgggggccagggaaccctggtcaccgtctcctcaagcctccaccaagggcccatcggtcttcccctggcgccctgctccaggagcaccttcgagagcaacagcggccctgggctgccctggtcaaggactacttcctatatactgtctgagcgggctggcaaggcgcatag

SEQ ID NO: 793269 - DNA, 693 bp, Homo sapiens
  misc_feature: 65373.44.36.D03.1.pb.heavy.1.raw 65373
cgtatcgcctccctcgcgccatcagacagtatatacacgaccggtgctcgatttagctgcgtcacgatctctcttgggagctctgagagcgagcccagcccagaattcccaggtgttttcatttggtgatcagcactgaacacagaggactcaccatggagttcgggctgagctggttttccttgttgttattttacaaggtgtccagagtgaagtgcagttggtggagtccgggagacttggtccagcctggagggtccctgagactctcctgtgtcgcctctggattcaccatcagtgaccactatatggactgggtccgccaggctccagggaaggggcctggagtggcttgccgcagtaaaaacaaagtgccagctttatcacagagtacgccgcgtctgtgaaagccagattcaccctctcaagagatgacttcaagaactcattgattctgcgaaatgactaacctgaaaaccgaggacacggcatgtattattgtgttgtgtttatatcaggaactgtccactggggccagggaaccctggtcaccgtctctcagcctccaccaagggcccatcggtcttccctggcgccctgctccaggagcacctccgagagcacagcggccctggctgcctggtcaaggactacttcctatatactgtctgagcgggctggcaaggcgcatag

SEQ ID NO: 793270 - DNA, 695 bp, Homo sapiens
  misc_feature: 65378.44.55.E11.1.pb.heavy.1.raw 65378
cgtatcgcctcctcgcgccatcagacagtatatacacgaccggtgctcgatttagcactcgcacgttgggtttgggggggagagagggccagcactgggattccgaggtgtttccattcggtgatcagcactgacaaccagaggactcaccatggagtttttggctgagctgggttctccttgttggactttaaaaaggtgtccagtgtgaggtgcggctgatggagtctggaggaggcttagtccagcctgggggtcccagagacttcctgtgcagctctgggctcaccgtcagcagcaactacatgagtttggtccgccaggctcccagaaggggtggagtgggtcttcagtcatttatactggtgatttcacatactacgcagactccgtgaaggccgattcaccatctccagggacaattccggaacacgtttatcttcaaatgaaaaccctgagaggcgacgacacggccgtctattactgtgcgagacaagtcggcgctcgagtggttattattcgtttgacttctggggccagggaaccctggtcaccgtcgcctccgcctccaccaaggcccatcgtcttccctggcacctcctccaagagcacctctggggcacaggccgccctgggctgcctggtcagggactacttcctatatactgtctgaggcgggctggcaaggcgcatag

SEQ ID NO: 793271 - DNA, 659 bp, Homo sapiens
  misc_feature: 65386.44.57.F02.1.pb.heavy.1.raw 65386
cgtatcgcctccctcggcgccatcagacagtatatatacacgaccggtgctcgatttagctcgatatagttgggttttgggatgctttctgagagtcaaggacctcctggtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctgagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaaactgacctccgtgaccgccgcggacacggccgtttatttctgtgcgaggcgagactggtctttcaatctatggggccgtggcaccctgggtcactgttctcctcagcttccaccaaggggcccatcggtcttccccctggcgcccctgctccaggagcacctctgggggcacagccggccctgggctgcctgtcaaggactacttcctatatactgtctgagcgggctggcaaggcg

SEQ ID NO: 793272 - DNA, 598 bp, Homo sapiens
  misc_feature: 65393.UNK.UNK.UNK.pb.heavy.1.raw 65393
cgtatcgcctccctcgcgccatcagacagtatataacacgaccgggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaatttatgatattaactggttgcgacagggccgctgacaaggctggagtggatgggatggatgaagccctatagtggcaacacgggctttgcccagaagttccaaggcagagttagtatgaccaggagcacctcccaggtacagtctacatggaactgagcagcctgagatctgaggacacggccgtgtatttctgtggcgagagccaccagcacctggcttgacttgtggggccagggaaccctggtccaccgtctcctcagcctccaccaagggcccatcggtcttcccccctggcgccctgctccaggagcacctccgagagcacagcggccctgggcttgcctggtcaagactacttcctataatactgtctgagcggggctgggcaggcgcatag

SEQ ID NO: 793273 - DNA, 691 bp, Homo sapiens
  misc_feature: 65401.44.27.C05.1.pb.heavy.1.raw 65401
cgtatcgcctcctcgcgccatcagacagtatatacacgaccggtgctcgatttagacgcgatcgaagggtttggggcctgggagacgagcccagcactgaagtcgcccggtgtttccactcgtgatcatcactgaacacagaggacctcaccatggagtttgggctgagctggggttttcctcgttgccctcttaagaggtgtcatgtgtcagtgcaattcgtggagtctgggggaggcgtgccccagtagggcggggtcctgagactctcctgtgcagcctctggattcaccttcgataattggaatatgcagtgggtccgccaggctccaggcgaggggctggagtgggtggcaggtgtgtcatttcatggaggaatcagtctacggtgattccgttgaggccgattcaccatcccagagacaattcggaaacacagtgtctcttcaaatgaacagcctgagacctcaggacacggccgtgtatttttgtgcgagactatctgttcaaaatcgttcattcgacgcctgggccagggaaccctggtcaccgtctctcgcctccaccaagggcccatcggtcttccccctggcgcctgctccaggagcacctccgagagcacagcggcctgggctgcctggtcaaggactacttcctatatactgtctgagcgggctggcaaggcgcatag

SEQ ID NO: 793274 - DNA, 577 bp, Homo sapiens
  misc_feature: 65406.UNK.UNK.UNK.pb.heavy.1.raw 65406
ccgaccacgcttgctagggacttggagctaaggacgacatattgcctttagacagtcgaaggtgacgcctagctaccactgaacgtttaggcgccagatgcggtctgggatgacctaactcgcagcttatcgatgatctactgcacgctcaaccaaccagtcttgatgcgcgcgataggactgacgggatcgctacagacatttaactcgctgtacttaattgagaatcctagggatggataggaatagaatccaccccctatcacccccccccatagccctgctggggtttgagtttacttttattcgtgttggatggttgaacttcgggaagggagtaatgggttgtcacttcccctaacccaaagtactgttttacgagtggcgtgcaagccatagccagtcacaggaataaacaattcaacgtggcgtaagattgggcgcttgctgtggcggcattgcaagctggtgcagcattgcgcatgctagacgacaatatgattgcgggacccagccagatgcccgatgcgggtccgcagctttgacctggaccaggtgcatagcctgcccagccttc

SEQ ID NO: 793275 - DNA, 714 bp, Homo sapiens
  misc_feature: 65419.44.62.F07.1.pb.heavy.1.raw 65419
cgtatcgcctccctcgcggccatcagacagtatatacacgaccggtgctcgatttagtagtcgcataaagggaaaggggactctgagagaggagcccagccctgggattttcaggtgtcttcatttggtgaccaggaccgaacagagagaagtctccatggagtttgggctgagctgccttttttctttgtggcttttttaaagggtgtcgtgtgtgaagtgcagttgttggagtctggggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccgggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793276 - DNA, 736 bp, Homo sapiens
  misc_feature: 65461.UNK.UNK.UNK.pb.heavy.1.raw 65461
cgtatcgcctccctcgcgcccatcagacagtatatacacgaccgcccgtgcctcgattttagcactcgcacgttgggtttgggggggagaggagcccagcaactccgggattccgaggtgtttccattcggtgatcagcactgaacacagaggactcaccatggagttttggctgagctgggttctccccttgttggacttttaaaaaggtgtccagtgtgaggtgcggctgatggagtctggaggaggcttagtccagcctggggggccccagagactctcctggtgcaggcctctgggcctcaccgtcagcagcaaactacatgagttggcgtcgccagggctccagggaaggggggctggagtgggtctcagtcatttatactggtgatttcacatactacgcagactccgtgaagcggccggattcaccatctcccagggacaattccaggaacaccggtttatcttcaaatgaacaacgctgagaggcgacgacacggccgtctattactgtgcgagacaagtcggcgctcggcagtggttattattcgtttgacttctggggcccaggaaccctggtcaccgtcgcctccgcctccaccaagggcccatcggtcttttcccccctggcaccctcctccaggagccacctctgggggccacagcggccctgggctgcctggtcaaggactacttcctatgatctgtctgagcgggctggcaaggcgcatag

SEQ ID NO: 793277 - DNA, 714 bp, Homo sapiens
  misc_feature: 65474.UNK.UNK.UNK.pb.heavy.1.raw 65474
ctatgcgccttgccagcccgctcagacagtatataggaagtagtccttgaccaggcagcccagggccgctgtgcccccagaggtgctcttggaggagggtgccagggggaagaccgatgggcccttggtggaggctgcggcgacggtgaccagggctccctggccccaggagttgaaccacccacccactgtggatccagtcccccccctcttcgcacagaaataaagggccgtgtcttcgactctcaggctgttcatttccagaaaaagtgtgtttccggaattgtctctggagatggtgaagcggcccttcacggactctccgtagtatgtgtcagttgcactagcgccaattgtcgagacccactcgagccccttccctggagcctggcggacccaggtcatggcatagctcctaaaggggaagccagaggctgcacaggagagtctcagggaccccccaggctgtgccaatcctcccccagactccaacagggccacctcacactggacaccttttaaatagtcacaagaaaaagccacctcagcccaaactccatggtgagttctctctgttcagtcctgatcaccaaatgaaaacacctgaaaatcccagggctgggctcctctctcagagctccccgcgacagacgtctgctaaatcgagccaccggtcgtgtatatactgtctgatggcgcgagggaggcgatacg

SEQ ID NO: 793278 - DNA, 661 bp, Homo sapiens
  misc_feature: 65494.UNK.UNK.UNK.pb.heavy.1.raw 65494
cgtatcgcctccctcgcgccatcagacagtatatacacgaccggtggctcgatttagtagtgtagattcgcgcgggggctttctgagagtcatggacctcctgtgcaagaacatgaagcacctgtggttcttcctcctgctggtggcggctccagatgggtcctgtcccagctgcagctgcaggagtcgggccaggactggtgaagccttcggagaccctgtccctcacctgcactgtctctggtggctccatcagcagtagtagttactactgggctggatcgccagccccccagggaagggctggagtggattgggagtatctattatagtgggaggcacctactacaacccgtcctcaagagtcgagtcaccatatcgtagacacgtccaagaaccagttctccctgaagctgagctctgtgaccgccgcggacacggccgtgtattactgtgcgagagtagggcattcgtcaccaactactttgaccactggggccagggaaaccctggtcaccgtctcctcagcctccaccaagggcccatcggtcttccccctggcaccctcctccaagagcacctctggggggcacagcggccctggctgcctggtcaaggactacttcctatatactgtctgagcggctggcaaggcgcatag

SEQ ID NO: 793279 - DNA, 550 bp, Homo sapiens
  misc_feature: 65509.44.43.D10.1.pb.heavy.1.raw 65509
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccaggttccctggccccaggggtcgaaccacctcccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgagggcccaggcttcttcacctcagccccttactgctagtctaaatcgagcaccggtcgtgtatatactgtctgatggcgcgagggaggcgatacg

SEQ ID NO: 793280 - DNA, 705 bp, Homo sapiens
  misc_feature: 65522.44.55.E11.1.pb.heavy.1.raw 65522
ctatgcgccttgccagcccgctcagacagtatataggaagagtccttgaccaggcagcccagggccgctgtgcccccagaggtgctcttggaggagggtgccagggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 793281 - DNA, 691 bp, Homo sapiens
  misc_feature: 65527.44.45.E01.1.pb.heavy.1.raw 65527
cgtatcgcctccctccgcgccatcagacagtatatacacgaccggtgctcgatttagtgagtcagtaagggaaaggggctgggagaggagcccagcactagaagtcggcggtgtttccattccggtgatcagcactgaacacagaggactcaccatggagttttgggctgagctgggttttcctcgttgctcttttaagaggtgtccagtgtcaggttcagctggtggagtctgggggaggcgtggtccagcctggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaaggggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaaggggcccatcggtcttccccctggcgccctgctccaggagcacctccgagagcacagcggccctgggctggcctggtcaaggactacttcctatatactgtctgagcggggctggcaaaggccgcatag

SEQ ID NO: 793282 - DNA, 689 bp, Homo sapiens
  misc_feature: 65533.44.72.G06.1.pb.heavy.1.raw 65533
ctatgcgccttgccagcccgctcagacagtatataggaagtagtccttgaccaggcagcccagggccgctgtgctctcggaggtgctctggagcagggcgccaggggaagaccgatgggcccttggtggaggctgaggagacggtgaccagggttccctgacccagtagtcaatgagccacccagcgcctcccgcacaataatacacagccgtgtcctcgactctcagactgtttcattgcagatacagtgagttcttggcgttgtctctggagatggtgaatcggcccttcacagagtccacatagtgtgtctcagttccatctttcttcatgatggccacccactccagccccttccctggagcctgggcggacccagttcatccaataactactaaaggtgaatccagaggctgcacaggagagtctcagggaccccccaggctggaccaagcctcccccagactcaccagttgcacctcacactggacaccttctaaaatagcaacaaggaaaacccagctcagtcccaattccatgtgagtcctctgtgctcagtgctgatcaccaagtggaaagggccttggagtccagggctaaggctcctctctcccctttccttgcagtcgtagctaaatcgagcaccggtcgtgtatatactgtctgatggcgcgagggaggcgatacg

SEQ ID NO: 793283 - DNA, 591 bp, Homo sapiens
  misc_feature: 65538.44.78.H01.1.pb.heavy.1.raw 65538
ctatgcgccttgccagcccgctcagacagtatataggaagtagtccttgaccaggcagccagggccgctgtgctctcggaggtgctcctggagcagggcgccagggggaagaccgatgggccttggtggaggctgaggagacggtgaccagggttccctggccccacaagtcaagccagggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactataggcttcatccatcccatccactccagccttgtccagcggcctgtcgcacccagttaatatcataattgatgaacgtgtatccagaagccgtgcaggagactgtcactgaggccccaggcttcttcacctcagccccagactgcaccagctgtacctggggagtgggaccgtcagtcttcctcttccccccaaacccaaactactcacactaaatcgagcaccggtcgtgtatatactgtctgatggcgccgagggaggcgatacg

SEQ ID NO: 793284 - DNA, 604 bp, Homo sapiens
  misc_feature: 65545.UNK.UNK.UNK.pb.heavy.1.raw 65545
cccgacacgcttgctaggacttgagctaaggacgacatattgcctttagacagtcgaaggtgacgccttagctaccactgaacgtttaggcgccagatgcggtctgggatgacctaactcgcagcttatcgatgatctactgcacgctcaaccaccaggtcttgatgcgcgcgataggactgacgggatcgctacagacattactcgctagtaacttaattgagatctaggggatgggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgtttgcagccatagccagtcacaggtaataaacaattcaacgtggcgtaaagattggcccgcttgctgtgggcatgcaagctgggtttggcagcattgtgcatgctagacgacaatatgaatcgcgggaccccctagtggccaagatggccgctagcgggttccgcagcttttgacctggaccagggtgcataagcctgcccagcctttc

SEQ ID NO: 793285 - DNA, 708 bp, Homo sapiens
  misc_feature: 65600.44.55.E11.1.pb.heavy.1.raw 65600
cgtatcgcctccctcgcgccatcagacagtatatacacgaccggtgctcgatttagcactcgcacgttgggtttgtggagaggagcccagcactgggattccgaggtgtttccattcgggtgatcagcactgaacacagaggactcaccatggagtttttggctgaggctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggcagggaaaccctggtcaccgtcgcctccgcctccaccaagggcccatcgcgtcttccccctggcaccctcctccaaggagcacctctggggggccacagcggccctgggctgcctggtcaaggactacttcctaatactgtctgagcgggctggcaaggcgcatag

SEQ ID NO: 793286 - DNA, 709 bp, Homo sapiens
  misc_feature: 65606.44.70.G04.1.pb.heavy.1.raw 65606
ctatgcgccttgccagcccgctcagacagtatataggaagtagtccttgaccaggcagcccagggccgctgtgctctcggaggtgcctcctggagcaggcgccaggggaagaccgatgggcccttggtggaggctgaggagacggtgaccagggtcccctggcccccagtcatgcgcccggtaataactactaccacctcccgatctcgcacagtaatacagagccgagtcctcgactctcaggctgaccatttccaagtacacaatgttccgggaattgtctctggagatggtgaatcggcccttcacggagtctgcataatattcagaacttccatcatgtgctataactggccaaccactccggccccttgcctggagcctggcggacccagtgcatgccagaaccactgaaactaaatccagaggcttcacaggagagtctcagggacctcccaggctggaccacgcctcccccagactccaccaggtgcacctgacagtggacacctcttaaaaagagcaacgaggaaaacccagctcagcccaaactccatggtgagtcctctgtgttcagtgctgatcaccgaatggaaacaccgccgacttctagtgctggctcctctcccagacccctttcccttcacactacactaaatcgagcaccggtcgtgtatatactgtctgatggcgcgagggaggcgatacg

SEQ ID NO: 793287 - DNA, 659 bp, Homo sapiens
  misc_feature: 65657.44.12.B01.1.pb.heavy.1.raw 65657
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctcatcagcagtagtagttactactggggctggatccgccagcccccagggaagggctggagtggattggagtatctattatagtgggagcacctactacaacccgtccctcaagagtcgagtcaccatatcagtagacacgtccaagaaccagttctccctgaagctgagctctgtgaccgccgcgacacggccgtgtattactgtgcgagagtagggcagttcgtcaccaactactttgaccactgggccagggaaccctggtcaccgtctcctcagcctccaccaagggcccatcggtcttccccctggcacctcctccaagagcacctctgggggcacagcggccctgggctgcctggtcaaggactacttcctatatactgtctgagcgggctggcaaggcgcatag

SEQ ID NO: 793288 - DNA, 697 bp, Homo sapiens
  misc_feature: 65699.44.55.E11.1.pb.heavy.1.raw 65699
ctatgcgcctgcgcccgctcagacagtatataggaaagtttagccttgaccaggcagcccaggccgctgtgcccccagaggtgctcttggaggagggtgccaggggaagaccgatggcccttggtggaggcggaggcgacggtgaccagggttccctggccccagaagtcaaacgaataataaccactccgagcgccgacttgtctcgcaccagtaatagacggccgtgtcgtcgcctctcaggttgttcatttgaagataaaccggttcctgaattgtccctggagatggtgatcggcccttcacgggagtctgcgtagtatgtgaaaatcaccagtataaatgactgagacccactccagcccttcctgagcctggcggacccaactcatgtagttgctgctgacggtgagccagaggctgcacaggagagtctctggaccccccaggctggactaagccctcctccagactccatcagccgcacctcacactggacaccttttaaaagtccaacaaggagaacccagctcagccaaactccatggtgagtcctctgtgttcagtgctgatcaccgaatggaaacaccttcggaatcccagtgctgggctctctccccccaaacccaaacgtgcgagtgctaaatcgagcaccggtcgtgtatatactgtctgatggcgcgagggaggcgatacg

SEQ ID NO: 793289 - DNA, 646 bp, Homo sapiens
  misc_feature: 65710.44.86.H09.1.pb.heavy.1.raw 65710
cgtatcgcctccctcgcgccatcagacagtatatacacgaccggtgctcgatttagtgctatagacttgggttggggatgctttctgagagtcaaggacctcctgtgcaagaacatgaagcacctgtggttttcctcctgctggtggcagctccagatgggtcctgtcccaggtgcagctgcaggagtcgggcccaggactggtgaggccttcgggaaccctgtctctcatctgcactgtctctgagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccagggcccatcggtcttccccctggtgccctgctccaggagcacctctggggcacagcggcctgggctgcctggtcaaggctacttcctatatactgtctgagcgggctggcaaggcgcatag

SEQ ID NO: 793290 - DNA, 632 bp, Homo sapiens
  misc_feature: 65712.UNK.UNK.UNK.pb.heavy.1.raw 65712
gaaggctgggcaggctatgccaccctggtccaggtcaaaaggctgcggaaccccgctagcggccatcttggccactaggggtcccgcagatttcatattgtcgtctagcatgcacaatgctgcaaaacccagcttgcaatgcccacagcaaagcgggccaaatctttacgccacgttgaattgtttattacctgtgactggctatggcttgccaacgccactcgtaaaaaactagtactttgcggttagggggaagtagacaaacccattactcccacttcccggaagtttcaactcattcccaacacgaaaataaaagtaaactcaacaccccaagcaggctatgggggggggtgataggggtggattctatttcctatcccatcccctaggatctcaattaagttacttagcgagtttaaatgtctgtagcgatcccgttcagtcctattcgcgcgcatcaagacctggttggttgagcgtgcagtagaatcatcgataagctgcgagttaggtcatcccagacccgcaatctggcgcctaaaacgttcagtggtagctaaggcgtcacctttcgactgtctaaaggcaatatgtcgtccttagctccaagtccctagcaagcgtgtcgg

SEQ ID NO: 793291 - DNA, 679 bp, Homo sapiens
  misc_feature: 65727.44.62.F07.1.pb.heavy.1.raw 65727
ctatgcgccttgccagccgctcagacagtatataggaagtagtccttgaccaggcagcccagggcgctgtgctctcggaggtgccctggagcagggcgccaggggaagaccgatgggccttggtggaggctgaagagacggtcacactgtccccggccccaagtactaaaggtgtcatggggtcaccgtggtcctgcttcaaacagtaaagacgcctgtgtcctcgggtctcaggtttttcattggagaaacaatttgtcctgcgattgtcctggaaatgtgaagcggcccttcacggagtctccgtagaaagtgacaccacagctccgatacttgagacccacccagtccctccctggagcccggcggacccaggtcatgccataggcactaaaggtgaatccagaggccgcacaggagagggtcagggacctcccagccgaatcaggcccccagactccaacaactgcactcacacacgacaccctttaaaaaagccacaaaaaaggcagctcagcccaaactccatggagacttctctctgttcggtcctgtcacaaatgaagacactgaaaatccaggctgggctcctctctcagagctccctttcccttatgcgactactaaatcgagcaccggtcgtgtatatactgtctgatggcgcgagggaggcgatacg

SEQ ID NO: 793292 - DNA, 646 bp, Homo sapiens
  misc_feature: 65737.44.53.E09.1.pb.heavy.1.raw 65737
ctatgcgccttgccagcccgctcagacagtatataggaagtagtcctttgaccaggcagccagggccgctgtgctctcggaggtgctcctggagcaggcgccagggaagaccgaatgggcccttggtggaggctgaggatgaggagacggtgaccgtggtccttggcccccagacgtcccaagcgtagtagaattgagacgacctgccataggcggacccatgtctgacacagtagtagacagcgtgtcggcggcggccacagaactcactttcaggaaaactgtgtcctcgacgtgtccacggatatggtgactcgaccgttgagggacggttgtagtaggtgttccactataatagagactcccatcactgcagcccctctcctgggggctggcggatccagccccagtagaaattacttctgtcgatgggaggcaccagagaccgtgcacgtgagggacagggtctccgaaggcttcaccagtctgggccgactcccgcagctgcgctgagacaggacccatctgggagcccgcaccaggcaggaggaagaccacaggtgcttcccccaaacccaacacactctctctaaatcgagcaccggtcgtgtatatactgtctgatggcggcgaggaggcgaatacg

SEQ ID NO: 793293 - DNA, 707 bp, Homo sapiens
  misc_feature: 65766.44.27.C05.1.pb.heavy.1.raw 65766
cgtatcggcctccctcgcgccatcagacagtatatacacgaccggtgctcgatttagacgcgatcgaagggtttggggcctgggagacgagcccagcactggaagtcgccggtgtttccactcgggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattgggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793294 - DNA, 698 bp, Homo sapiens
  misc_feature: 65769.44.36.D03.1.pb.heavy.1.raw 65769
cgtatcgcctccctcgcgccatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 793295 - DNA, 654 bp, Homo sapiens
  misc_feature: 65775.44.23.C01.1.pb.heavy.1.raw 65775
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatgacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgtcaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgcgagggaggcgatacg

SEQ ID NO: 793296 - DNA, 551 bp, Homo sapiens
  misc_feature: 65787.44.43.D10.1.pb.heavy.1.raw 65787
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaacccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793297 - DNA, 721 bp, Homo sapiens
  misc_feature: 65795.44.56.F01.1.pb.heavy.1.raw 65795
ctatgcgcccttgccagcgccgctcagacagtatataggaagtagtccttgaccaggcaggcccagggccgctgtgcccccagaggtgctcctggagcagggcgccagggggaagaccgatgggcccttggtggaagctgaagagacggtgaccattgtcccctgggccccaaatatcaaatgcatcgacgtcccaggatcgcctggcgcagtaatagacgcctgtgtcgtcgggtctcaggttgcttcatttgtaattggccaacactgttggagtcaatcccttgaagacggtgaatcttcccttcacagacgcggcgtactctttacttccaccataacgtttcattctgacgaaagtgatccactccgccccttccctggagcctgacggacccaggcaagtggataatcactagactgaatcctgagactacacaggagagtctcagagaccgccctggctgtgccaagcccccccccgactccgccagtcgcccctcgccactggacacctctaaaaaactaccaaggaaatcaagattagcccaaactccatggttggtggtctgtgctcagtgctgatcaccaagtggaaactcctgggaatctcaccggctggggctcctctcccagagctcccctttgtgtgttcagacgtctgctaaatcgagcaccggtcgtgtatatactgtctgatggcgcgagggaggcgaatacg

SEQ ID NO: 793298 - DNA, 571 bp, Homo sapiens
  misc_feature: 65797.44.78.H01.1.pb.heavy.1.raw 65797
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctgggaggtgctcctggtcatactaactctgccttggaacttctgggcaaagcccgtgttgccactatagggcttcatccatcccatccactccagcccttgtccagcgcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 793299 - DNA, 599 bp, Homo sapiens
  misc_feature: 65798.44.36.D03.1.pb.heavy.1.raw 65798
ctatgcgccttgcagcccgctcagacagtatataggaagtagtccttgacaggcagcccagggccgctgtgccccagaggtgctcctggagcagggcgccagggggaaagaccgatgggcccttggtggaagctgaggagacggtgaccgtggtccctttgccccagacgtccagatggtaagacttataatacagaaccagcttttctttcccgcattaccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccaggcctccctgggggctgacggatccagctcacacccattctaatatcgttgagagagacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatgcgcgagggaggcgatacg

SEQ ID NO: 793300 - DNA, 701 bp, Homo sapiens
  misc_feature: 65804.UNK.UNK.UNK.pb.heavy.1.raw 65804
ctatgcgccttgccagcccgctcagacagtatataggaagtagccttgaccaggcagcccagccgctgtgctctcggaggtgctcctgagcagggcgccaggggaagaccgatggcccttggtggaggctgaggagacggtgaccagggttccctggccccagtggacagttcctgatataaacacaacacaataatacatgcccgtgtcctcggttttcaggtagtcattcgcagaatcaatgagttcttgaagtcatctcttgagagggtgaatctggctttcacagacgcggcgtactctgtgataaagctggcaactttgttttttactgcggccaaggccactccagccccttccctggagcctggcggaccccagtccatatagtggtcactgatggtgaatccagaggcgacacaggagagtctcagggaccctccaggcctggaccagtctcccccggactccaccaactgcactcactctggacacccttgtaaaataacaacaaggaaaacccagctcaggccccgaactccatggtgagtcctctgtgttcagtgctgatcaccaaatgaaacacctgggatttctggggctgggggctccgctctcagagctccccaagagagatcgtgacgcgctaatcgagcaccggtcgtgtatatactgtctgatggcgcgagggaggcgatacg

SEQ ID NO: 793301 - DNA, 746 bp, Homo sapiens
  misc_feature: 65814.44.73.G07.1.pb.heavy.1.raw 65814
ctatgcgccttgccagcccgctcagacagttatataggccaaagtagtcctacccagacgaccaccgcagcccagggccggctgtgctctcggaggtgctcctggagccagcagggcgccagggaagaccgatgggcccttggtggagggctgaggagacggcggtgaccagtgttcccctggcccccagtgaaacgcccgataatagctgctgccactttccgatctccgcacagtaatacagagcccgagttcccccgctctcaggctgatcattttccaggtaccaggagtgttccggggaattgtctctggagatggtgaatcggcccttcacggagtctgcataatatctagaagttcctcatatgctataactgcccaaccactccggcgccccttgcctggagcctggcggacccagtgcatgccagaactactgaaactaaattccagaggcttcacaggagagtctcagggaacctcccaggctggaccacgcctcccccaagactccaccaaggtggcacctgacactggacaccctcttaaaagagtaacgaggaaaaccccagctcagcccaaactccatggtgagtcctctgtgtttcagtgctgatcaccgaatggaaacaccgccgacttctagtgctgggctcctctcccagagctccccctgagcgtagagctaaatcgagcaccggtcgtgatagtatagactggatggcgccgagggaggcgatacg

SEQ ID NO: 793302 - DNA, 699 bp, Homo sapiens
  misc_feature: 65815.44.27.C05.1.pb.heavy.1.raw 65815
ctatgcgccttgccagcccgctcagacagtatataggaagtagtccttgacaggcagcccagggccgctgtgctctcggaggtgctcctggagcagggcgccaggggaagaccgatgggcccttggtggaggccgaggagacggtgaccagggttccctggccccaggcgtcgaatgaaccgattttggaaacagatagtctcgcacaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctccagccccaaacccttcgatcgcgtctaaatcgagcaccggtcgtgtatatactgtctgatggcgcggagggaggcgatacg

SEQ ID NO: 793303 - DNA, 688 bp, Homo sapiens
  misc_feature: 65847.UNK.UNK.UNK.pb.heavy.1.raw 65847
ctatgcgccttgccagcccgctcagacagtatataggagtagtccttgaccaggcagccagggccgctgtgctctcggagtgctcctggagcagggcgccaggggagaccgatgggcccttggtggaggctgaggagacggtgaccagggttccctggcccagtggacagttcctgatataacacaacacaataatacatgcccgtgtctcggttttcaggttagtcattcgcagaatcaatgagttcttgaagtcatctcttgagagggtgaatctggctttcacagacgcggcgtactctgtgataaagctggcaacttgttttactgcggccaagccactccagccccttccctggagcctggcggacccagtccatatagtggtcactgatggtgaatccagaggcgacacaggagagtctcaggaccctccaggcttggacaagtctcccccgactccaccaactgcacttcactctggacaccttgtaaataacaacaaggaaaccagctcagcccgaactccatggtgagtcctctgtgttcagtggctgatcaccaaatgaaaacacctgggaattctggggctgggctccgctctcagagctcccaagagagatcgtgacgcagctaaatcgagcacggtcgtgtatatactgtctgatggcgcgagggaggcgatacg

SEQ ID NO: 793304 - DNA, 724 bp, Homo sapiens
  misc_feature: 65887.44.85.H08.1.pb.heavy.1.raw 65887
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctccctctcccagagctcccgcgactgagtgatactaaatcgagcaccggtcgtgtatatactgtctgatggcgcggagggaggcgatacg

SEQ ID NO: 793305 - DNA, 664 bp, Homo sapiens
  misc_feature: 65909.44.53.E09.1.pb.heavy.1.raw 65909
ctatgcgccttgccagcccgctcagacagtatataggaagtagtccttgaccaggcagcccagggccgctgtgctctcggagtgctcctgggcagggcgccaggggaagacgatggcccttgtggaggctgaggagacggtgaccagggttccctggccgaatgaaaccatcccagacagtaatagacggctgtgtcctcggtgttcaggctgttcatctgcagagacaccgtatcttttgaatcatctcttgagatggtgatctgcctttcacggtgcagcgtagtctgctgtccaccgtcagctttggttctaatacggccaacccactccagccccttcctggagcctggcggacccaggtcatcccaggcgttactgaaagtgaatccagagctgcacaggagagtctaaggactcccaggctttaccaaaccccccagactcaccaactgcacctcacactggacaccttttaaaatagcagcaaggaaatccagctcagcccaaactccatggtgagtcctctgtgttcagtcctgatcactgaatgaaaacacctgggaatcccaaggctggggctcctctccagagctcaacacactctctctaaatcgagcaccggtcgtgtatatactgtctgatggcgcgaggaggcgatacg

SEQ ID NO: 793306 - DNA, 689 bp, Homo sapiens
  misc_feature: 65943.44.9.A09.1.pb.heavy.1.raw 65943
ctatgcgcctgcccagccgctcagacagtatataggaagtagtccttgaccaggcagcccagggccgctgtgctctcggaggtgctcctggagcagggcgccagggggaagaccgatggcccttggtggaggctgaggagacggtgaccagggttccctggccccagtagtcaagcgggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagcccttgcctggagcctggcggacccagtgcatggcataggtcctgaagatgaatccagaggctgcacaggagagtctcagggagttcccaggctgggccgctcctccccagactccactagctgcacctgacactggccacctcttaaaagagcaacgaggaaaacccatctcagcccaaagtccatggtgagtcctctgtgttcagtgatgatcaccgaatggaaacaccggcgaacttccagtgctgggctcgtctccccccctgcgcgtctcgctaaatcgagcaccggtcgtgtatatactgtctgatggcgcgagggaggcgatacg

SEQ ID NO: 793307 - DNA, 730 bp, Homo sapiens
  misc_feature: 65945.44.33.C11.1.pb.heavy.1.raw 65945
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatcacgagccccatctctcgcacagtagtagacagccgtgtcctcggctctcaggcctattcatttccagatatagtgtgtcttcgaattgtctctggagatggtgaatcggcccttcaacggaaatctacataatatttattacttcccatcaataccatataagtgcccaccactccagtcccttgcctggagcctggcggacccagtgcatgccatgtctgttgaaggtgaatccagacgctacacaggagagtctcaggaccctcccaggctggaccacgcctccccagactcaccagcttcacctgacactggacacctcttaaaagagcaacgaggaaaacccaggtcagcccaaactccatggtgagtcctctgtgttcggtgctgatcaccggactgaaacaccgccgacttctggtctgggctcctctcccagagctcccaaaacccaacgagctcactctaaatcgagcaccggtcgtgtatatactgtcctgatggcgcgagggaggcgatacg

SEQ ID NO: 793308 - DNA, 669 bp, Homo sapiens
  misc_feature: 65946.UNK.UNK.UNK.pb.heavy.1.raw 65946
ctatgcgcttgccagccgctcagacagtatataggaagtagtccttgaccaggcagcccaggccgcttgtgctctcggaggtgctcctggagcaggcgccaggggaagaccgatggccttggtggagctgaggagacggtgaccagggttccctgacccagtagtcaatgagccaccagcgcctcccgcacaataatacacagccgtgtcctcgactctcagactgttcatttgcagatacagtgagttcttgggcgttgtctctggagatggtgaaatcggccttcacagagtccacatagtgtgtctcagttccatctttcttcatgatggccacccactccagccttccctggagcctggcggacccagtcatttcatataactactaaaggtgaatccagaggctgcacaggagagtctcagggacccccaggctggaccaagcctccccagactccacagttgcactcacactggaaccttctaaaatagcaacaaggaaaacccagctcagtccaattccatggtgagtctctgtgctcagtgctgatcacaagtgaaagccttggagtccagggctaggctcctctctcccttttccttgcagtcgtagctaaatcgaggaccgtcgtgtatatactgtctgatgcgcgagggcgcgatacg

SEQ ID NO: 793309 - DNA, 687 bp, Homo sapiens
  misc_feature: 65948.UNK.UNK.UNK.pb.heavy.1.raw 65948
cgtatcgcctcccctcgcgccatcagacagtatatacacgaccgtgctcgatttagagagagtgtgttgagctatgggagaggagccccagccttgggattcccaggtgtttttcattcagtgatcaggactgaacacagaggactcaccatggagtttgggctgagctggatttccttgctgctattttaaaaggtgtccagtgtgaggtgcagttggtggagtctgggggaggtttggtaaagccttggggagtcccttagactctcctgtgcagcctctggatttcactttcagtaacgcctggatgacctgggtccgccaggctccagggaaggggctggagtggggttggccgtattagaaccaaagctgacggtgggacagcagactacgcctgcacccgtgaaaggcagattcaccatctcaagagatgattcaaaagatacggtgtctctgcagatgaacagcctgaacaccgaggacacagccgtctattactgtctgggatggtttcattcggcgccagggaaccctggtcaccgtctcctcagcctccaccaaggggcccatcggtcttccccctggcgccctgctccaggagcacctccgagagcacagcgccctgggctgcctggtcaagactacttcctatatactgtctgagcgggctggcaaggcgcatag

SEQ ID NO: 793310 - DNA, 709 bp, Homo sapiens
  misc_feature: 65956.UNK.UNK.UNK.pb.heavy.1.raw 65956
gagagactgacagcgtatcgcccttcccttcgcgccatcagacagtatatacacgaccggtgctcgattagctgcgttcacgatctctcttgggggagagcggagcccagccccagaatttcccaggtgtttttcatttggtgattcagcactgaacacagaggactcaccatggagttcgggctgagctgggttttccttgttgttattttacaaggtgtccagagtgaagtgcagttggtggagtccggggagacttggtccagcctggagggtccctgagacttctcctgtgtcgcctctggattcaccatcagtgaccactatatggactgggtccgccaggctccagggaaggggctggagtggcttggccgcagtaaaacaaagttgccagctttatcacagagtacgccgcgtctgtgaaagccagattcaccctctcaagagatgacttcaagaaccattgattctgcgaatgactacctgaaaaccgaggacacgggcatgtattattgtgttgtgtttatatcaggaactgtccactggggccagggaaccctggtcaccgtctcctcagcctccaccaagggcccatcggtcttccctggcgcctgctccaggacacctccgagagcacagcggccctggcctgcctggtcaaggactacttcctatatactgtctgagcgggctggcaaggccatag

SEQ ID NO: 793311 - DNA, 696 bp, Homo sapiens
  misc_feature: 65961.UNK.UNK.UNK.pb.heavy.1.raw 65961
cgtatcgcctccctcgcgccatcagacagtatatacacggaccggtgctcgatttagacgcgatcgaagggttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtcctgagactctcctgtgcagcctctggattcaccttcgataattggaatatgcagtggtccgccaggctccaggcgaggggctggagtgggtggcaggtgtgtcatttcatggaggaaatcaagtctacggtgattcgttgagggcgattcaccatctccagagacaattccgagaacacagtgtctcttcaaatgaacagcctgagactcaggacacggccgtgtatttttgtgcgagactatctgtttccaaaatcggttcattcgacgctgggggccaggggaaccctggtcaccgtctcctcggcctccaccaagggccatcggtcttcccctggcgccctgctccaggagcacctccgagagcacagcggccctgggctgcctggtcaaggactactcctatatactgtctgagcgggctggcaaggcgctag

SEQ ID NO: 793312 - DNA, 706 bp, Homo sapiens
  misc_feature: 65983.44.73.G07.1.pb.heavy.1.raw 65983
cgtatcgcctccctcgcgcccaatcagacagtatatacacgaccggtgctcgatttagctctacgctcaggggagctctgggagaggagcccagcactagaaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgttgaagcctctggatttagttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactgggccaggggacactggtcaccgtctcctcagccctcaccaagggcccatcggtcttccccctggcgccctgctccaggagcacctccgagagcacagcggccctgggctgcctggtcaagactacttcctatatactgtctgagcgggctggcaaggcgcatag

SEQ ID NO: 793313 - DNA, 677 bp, Homo sapiens
  misc_feature: 65993.44.29.C07.1.pb.heavy.1.raw 65993
ttcgtatcgcctccctctgcgccatcagacagtatatacacgaccggtgctcgatttagagtgctacgaagggaaagggggactcctgtgccccaccatggacacacttttgctccacgctcctgctgctgaccatcccttcatgggtcttgtcccagatcaccttgaaggagtctggtcctacgctggtgaagcccacacagacctcacgctgacctgcaacctctctggtttctcactcaggagtgatggagcgattgtgggctgggtccgtcagcccccaggaaagggccctggagttggcttgcactcattattggggatgatgataggcgctacagtccatctctgaagagcagactcctccatcaccggagacgcctcaatacgcagagtgatccttaaagtaggccaacatggcccctgcggacacagccacatactactgcggcacacatgatcaactatataaaaaagtggtggttatgtgagtggctttgatattctggggcccaagggacaatggtccaccgtctcttcagcctccaccaagggcccatcggtcttccccctggcgccctgctccaggagcaccttccgagaacacagcggccctgggctgcctggtcaaggactacttcctatatactgtctgagcgggctggcaaggcgcatag

SEQ ID NO: 793314 - DNA, 736 bp, Homo sapiens
  misc_feature: 65999.44.36.D03.1.pb.heavy.1.raw 65999
cgtatcgcctccctcgcgccatcagacagtatataccacgaccggtgctcgatttagctgcgtcacgatctctcttggggaggctctgagaggcggagccagccagccccagaattcccaggtgtttttcattttggtgatcagcactgaacacagaggacttcaccatggagttcggggctgagctgggttttccttgtttgttattttacaaggtgtccagagtgaagtgcagttggtggagtccgggggagacttggtccagcctggagggtccctgagacttctcctgtgtcgcctctggattcaccatcagttgaccactatatggactggggtccgccaggctccagggaagggctggagtggcttgccgcagtaaaaaacaaagttggccaggcttttatcacagagtacgccgcgtctgtgaaaagccgatttcaccctctcaagagatgacttcaaagaaactcattgattctgcgaatgactaacctgaaaaagccgaggacacgggcatgtattattgtgttgtgttttatatcaggcaagctgtccactggggccagggaaaccctggttcaccgtctcctcagcctccaccaagggcccatcggtcttccccctgcgcgcccctgctccaggagcaacctccgagagcacagcggccctgggctgcctggtcaaggactactttcctatatactggtctgagcgggctggcaagggcgcatag

SEQ ID NO: 793315 - DNA, 688 bp, Homo sapiens
  misc_feature: 66000.44.78.H01.1.pb.heavy.1.raw 66000
cgtatcgcctccctcgcgccatcagacagtatatacacgaccggtgctcgatttagtgtgagtagtttgggtttgggagctctgggagaggagcccagccttgggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 793316 - DNA, 607 bp, Homo sapiens
  misc_feature: 66006.44.36.D03.1.pb.heavy.1.raw 66006
cgtatcgcctcctcggcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793317 - DNA, 684 bp, Homo sapiens
  misc_feature: 66014.UNK.UNK.UNK.pb.heavy.1.raw 66014
ctatgcgcctgcagcccgctcagacagtatataggaagtagtccttgaccaggcagccagggcgctgtgccccagaggtgctcttggaggagggtgccaggggaagaccgatgggcccttggtggaggcggaggcgacggtgaccagggttccctgcccagaagtcaaacgaataataaccactccgagcgccgacttgtctcgcacagtatagacggccgtgtcgtcgcctctcaggttgttcattgagataaaccgtgtcctggaattgtccctggagatggtgaatcggcccttcacggagtctgcgtagtatgtgaaatcacagtataaatgactgagacccactccagccccttccctggagcctggcggacccaactcatgtagttgctgctgacggtgagccagaggctgcacaggagagtctctgggaccccccaggctggactagcctcctccagactccatcagccgcacctcacactggacaccttttaaaagtcaacaaggagaacccagctcagccaaactccatggtgagtctctgtgttcagtgctgatcaccgaatgaaacacctcggaatcccagtgctgggctcctctccccaaacccaacgtgcgagtgctaaatcgagcacccgtcgtgtatatactgtctgatggcgcgagggaggcgatacg

SEQ ID NO: 793318 - DNA, 702 bp, Homo sapiens
  misc_feature: 66036.44.36.D03.1.pb.heavy.1.raw 66036
cgtatcgcctccctcgcgcccatcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagtttggtgggagtccggggggagacttggtccagcctggagggtccctgagacttctcctgtgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctctcagcctccaccaagggcccatcggtcttccccctggcgccctgctccaggagcacctccgagagcacagcggcctgggctgcctggtcaaggactacttcctatatactgtctgagcgggctggcaaggcgc

SEQ ID NO: 793319 - DNA, 726 bp, Homo sapiens
  misc_feature: 66048.44.33.C11.1.pb.heavy.1.raw 66048
cgtatcgcctccctcgcgccatcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgagacacggctgtctactactgtgcgagagatggggctcgtggatacagatatgacatgctctactccaatggtatggacgcctggggccaagggaccacggtcgccgtctcctcagcctccaccaaggggcccatcggtcttccccctggcaccctcctccaagagcacctctgggggcacagcggccctgggctgcctggtcaaggactacttcctatatactgtctgagcgggctggcaaggcgcatag

SEQ ID NO: 793320 - DNA, 605 bp, Homo sapiens
  misc_feature: 66073.UNK.UNK.UNK.pb.heavy.1.raw 66073
gaaggctggcaggctatgcaccctggtccaggtcaaaagctgcggaacccgctagcggccatcttggccactaggggtcccgcagattcatattgtcgtctagcatgcacaatgctgcaaacccagctgcaatgcccacagcaagcggccaatctttacgccacgttgaattgtttattacctgtgactggctatggcttgcaacgccactcgtaaaactagtacttgcggttagggggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtaggcgatcccgtcagtcctatcgcgcgcatcaagacctggttggttgagcgtgcagtagatcatcgataagctgcgagtaggtcatcccagaccgcatctggcgcctaaacgtcagtggtagctaaggcgtcaccttcgactgtctaaaaggcaatatgtcgtccttagctcaagtccctagcaagccgtgtcggg

SEQ ID NO: 793321 - DNA, 662 bp, Homo sapiens
  misc_feature: 66076.44.12.B01.1.pb.heavy.1.raw 66076
ctatgcgccttgccagcccgctcagacagtatataggaagtagtccttgaccaggcagccagggccgctgtgccccagaggtgctcttgggaggagggtgccaggggaagaccgatgggcccttggtggaggctgaggagacggtgaccagggttccctggcccagtgtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgttagtaggtgctcccactataatagatactcccaatccactccagccccttccctgggggctggcggatccagcccccagtagtaactactactgctgatggagccaccagagaacagtgcagggtgagggacagggtctccgaaggcttcaccagtcctggccgactcctgcagctgcagctgggacaggaccatctgggagccgccaccagcaggaggaagaaccacaggtgcttcatgttcttgcaccaggaggtccatgactctcagaaagccccgcggaatctacactactaaatcgagcaccggtcgtgtatatactgtctgatggcgcgagggaggcgatacg

SEQ ID NO: 793322 - DNA, 686 bp, Homo sapiens
  misc_feature: 66087.UNK.UNK.UNK.pb.heavy.1.raw 66087
ctatgcgccttgccagcccgctcagacagtatataggaagtagtccttgaccaggcagccagggccgctgtgctctcggaggtgctcctggagcagggcgccaggggaagaccgatgggcccttggtggaggctgaggagacggtgacagggttccctggccccagtggacagttcctgatataaacacaacacaataatacatgcccgtgtctcggttttcaggttagtcattcgcagaatcaatgagttcttgaagtcatctcttgagagggtgaatctggctttcacagacgcggcgtactctgtgataaagctggcaactttgtttttactgcgccaagcactccagccccttcctggagcctggcggacccagtccatatagtggtcactgatgtgaatccagaggcgacacaggagagtctcagggaccctccaggctggaccaagtctcccccggactccaccaactgcacttcactctggacaccttgtaaaataacaacaaggaaacccagctcagcccgaactccatggtgagtcctctgtgttcagtgctgatcaccaatgaaaacacctgggaattctggggctggggctccgctctccccaagagagatcgtgacgcagctaaatcgagcacggtcgtgtatatactgtctgaggcgcgagggaggcgatacg

SEQ ID NO: 793323 - DNA, 654 bp, Homo sapiens
  misc_feature: 66094.44.86.H09.1.pb.heavy.1.raw 66094
ctatgcgccttgccagcgcccgctcagacagtatataggaagtagtccttgaccaggcagcccagggccgctgtgccccagaggtgctcctggagcagggcgcagggggaagaccgatgggcccttgtggaagctgaggagacagtgaccagggtgccacggcccatagatgaaagaccagtctcgcctcgcacagaaataaacggccgtgtccgcgcggtcacggaggtcagtttcagggagaagcggttcatggacgtgtccctcgaaatgggtgagacgactcttgagggacggagagtagtacgtcgccccagtattaatggatgtcaccaatccactccatcccctccctgggggctgccggatccaagccccaagaatgatcagaactgatggaaactccagagacagtgcagatgagagacagggttcccgaaggcctcaccagtctgggcccgactcctgcagctgcacctgggacaggacccatctgggagctgccaccagcaggaggaaaaaaccacaggtgcttcatgttcttgcacaggaggtccttgactctcagaaagcatccccaaacccaagtctatagcactaaatcgagcaccggtcgtgtatattactgtctgatggcgcgagggaggcgatacg

SEQ ID NO: 793324 - DNA, 612 bp, Homo sapiens
  misc_feature: 66108.UNK.UNK.UNK.pb.heavy.1.raw 66108
gaaggctgggcaggctatgcaccctggtccaggtcaaaagctgcggaaccccgctagcggccatcttggccactaggggtcccgcagattcatattgtcgtctagcatgcacaatgctgcaaacccagcttgcaatgcccacagcaagcggccaatcttacgccacgttgaattgtttattacctgtgactggctatggcttgcaacgccactcgtaaaaactagtactttgcggttaggggaagtagacaaacccattactccacttcccggaagttcaactcattccaacacgaaataaaagtaaactcaacaccccaagcaggctatgtggggggggtgataggggtggattctatttcctatcccatcccctaggatctcaattaagttactagcggagttaaatgtctgtagcgatcccgtcagtcctatcgcgcgcatcaagacctggttggttgagcgtgccagtagatcatcgataagctgcgagtttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 793325 - DNA, 708 bp, Homo sapiens
  misc_feature: 66172.44.36.D03.1.pb.heavy.1.raw 66172
ctatgcgcccttgccagcccgctcagacagtatataggaagtagtccttgaccaggcagcccagggccgctgtgctctcggaggtgctcctggagcagggcgccagggggaagaccgatggcccttgtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtggataaagctgcaactttgttttactgcggccaagccactccagcccttccctggagcctgggcggacccagtccatatagtggtcactgatgggtgaatccagaggccgacacaggagagtctcagggaccctccaggctgggaccaagtctccccggactccaccaactgcacttcactctggacaccttgtaaaataacaacaagggaaaacccaagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactggtctgatggcgcgagggaggcgatacg

SEQ ID NO: 793326 - DNA, 700 bp, Homo sapiens
  misc_feature: 66207.44.73.G07.1.pb.heavy.1.raw 66207
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtcctgagactctcctgtgaagcctctggatttagtttcagtagttctggcatgcactgggtccgccaggctccaggcaaggggccggagtggttgcagttatagcatatgatggaacttctagatattatgcagactccgtgaaggccgattcaccatctccagagacaattcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793327 - DNA, 665 bp, Homo sapiens
  misc_feature: 66255.UNK.UNK.UNK.pb.heavy.1.raw 66255
ctatgcgccttgccagccgctcagacagtatataggaagtagtccttgaccaggcagcccagggccgctgtgctctcggagtgctcctggagcaggcgccaggggaagaccgatgggcccttgtggaggctgaggagacggtgaccaggttcctggcccgaatgaaaccatcccagacagtatagacggctgtgtcctcgtgtcaggctgttcatctgcagagacaccgtatcttttgaatcatctcttgagatggtgaatctgcctttcacgggtgcagcgtagtctgctgtcccccgtcagctttgttctaatacggccaaccactccagccccttcctggagcctggcggacccaggtcatccaggcgttactgaaagtgaatccagaggctgcacaggagagtctaagggactccccaggcttacaaacctccccagactccaccaactgcacctcacactggacaccttttaaaatagcagcaaggaaaatccagctcagcccaaactccatggtgagtcctctgtgttcagtcctgatcactgaatgaaaacacctggaatcccaaggctgggctcctctcccagagctccaacccaaactactcacactaaacgagcccgtcgtgtatatactgctgatggcgcgaggaggcgatacg

SEQ ID NO: 793328 - DNA, 697 bp, Homo sapiens
  misc_feature: 66262.44.36.D03.1.pb.heavy.1.raw 66262
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagctggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaacgaggacacgggcatgtattattgtgttgtgtttatatcaggaactgtccactggggccaggaaccctggtcaccgtctcctcagcctccaccaagggcccatcggtcttccccctggcgccctgctccaggagcacctcgagagcacagcggccctggctgcctggtcaaggactacttcctatatactgtctgagcgggctggcaaggcgcatag

SEQ ID NO: 793329 - DNA, 702 bp, Homo sapiens
  misc_feature: 66270.44.55.E11.1.pb.heavy.1.raw 66270
ctatgcgccttgccagcccgctcagacagtatataggaagtagtccttgaccaggcagcccagggccgctgtgcccccagaggtgctcttggaggaggtgccagggggaagaccgatggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctcttgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793330 - DNA, 724 bp, Homo sapiens
  misc_feature: 66272.44.33.C11.1.pb.heavy.1.raw 66272
cgtatcgcctccctcgcgccatcagacagtatatacacgaccggtgctcgatttagagtgagctcgttgggtttggggagctctggagaggagcccagcaccagaagtcggcggtgtttccagtcggtgatcagcaccgaacacagaggactcaccatggagtttggctgacctggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaatgaatagcctgagagccgaggacacggctgtctactactgtgcgagagatggggctcgtggatacagatatgacatgctctactccaatggtatggacgcctgggccaagggaccacggtcgccgtctcctcagcctccaccaagggcccatcggtcttccccctggcaccctcctccaagagcacctctgggggcacagcggcctgggctgcctggtcaaggactacttcctatatactgtctgagcgggctggcaaggcgcatag

SEQ ID NO: 793331 - DNA, 607 bp, Homo sapiens
  misc_feature: 66280.44.38.D05.1.pb.heavy.1.raw 66280
ctatgcgccttgccagccgctccgacagtatactagaagtaggctgcgcaggcggccacgcccgggggccgctggccccagaggtgctctggagcagggcgccagggggaagacgatgggccttgtggcgaagctgaggagacggtgaccgtggtcccctggccccagacgtccataccgtagtgagtagtatgcgcaactccccgaactcccgcaccggctcttgcacagtaatacacagccgtgtcctcggctctcagactgttcatttgcagatacagcgtgttcttggcgttgtctctgagatggtgatcggcccttcacggagtccgcgtagcttgtgctactcccatcactattaatacgtgagacccacaccagccccttcctggagcttggcgaccgtgcatccagtagctactgaaggtgaatccagagcctgcacaggagagtctcaggaccgccaggctgcgaactaagcctccccgactcaccagctgcacctcacactgacaccttttaaatagcaacaaggaaacccagctatcagatactaatcgagcaccggtcgtgtatatactgtctgatggcgcgaggaggcgatacg

SEQ ID NO: 793332 - DNA, 705 bp, Homo sapiens
  misc_feature: 66293.44.36.D03.1.pb.heavy.1.raw 66293
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggactgcctggtcaaggactacttcctatatactgtctgagcgggctggcaaggcgcatag

SEQ ID NO: 793333 - DNA, 612 bp, Homo sapiens
  misc_feature: 66297.UNK.UNK.UNK.pb.heavy.1.raw 66297
cccgacacgcttgctagggacttggagctaaggacgacatattgcctttagacagtcgaaggtgacgccttagctaccactgaacgtttaggcgccagatgcggtctggatgacctaactcgcagctatcgatgatctactgcacgctcaaccaaccaggtcttggatgcgcgcgataggactgacgggatcgctacagacatttaactcgctagtaacttaattgaatcctaggggatgggataggaaatagaatccacccctatcaccccccccccccacatagcctgctgtggggtgttgagtttacttttatttcgttggaatgagttgaaacttcgggaagtggagtaatggggttgtctacttcccctaaccgcaagagtactagtttacgagtggcgttgcaagccatagccagtcacaggtaataaacaattcacgtgcgtaaagattggccgctgctgtgggcattgcaagctggtttcagcagcattgtgcatgcagacgacaatatgaatctgcgggacccctagtggccaagatggcccgctagcgggttccgcagcgctttgacctggaccaggggtgcatagcctgccgcaggccttc

SEQ ID NO: 793334 - DNA, 676 bp, Homo sapiens
  misc_feature: 66298.44.21.B10.1.pb.heavy.1.raw 66298
cgtatcgcctccctcgccgccatcagacagtatatacacgaccggtgctcgatttagtgtcgtcgcaagagagagcggagcccagccccaggaattcccaggtgttttcattggtgatcagcactgaacacagaggactccaccatggagttcgggctgagctgggtttttccttgttgttattttacaaggtgtccagagtgaagtgcagttggtggagtccgggggagacttggtccagcctgggagggtccctgagactctccctgtgtcgcctctggattcaccatcagtgaccactatatggactgggtccgccaggctccagggaaggggctggagtggcttggccgcagtaaaaacaaagttgccagctttatcacagagtaccgccgcgtctgtgaaagccagattcaccctctcaagagatgacttcaagaactcattgattctgcgaatgactaacctgaaaaccgaggacacgggcatgtgtattttgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgg

SEQ ID NO: 793335 - DNA, 702 bp, Homo sapiens
  misc_feature: 66315.UNK.UNK.UNK.pb.heavy.1.raw 66315
ctatgcgccttgccagccccgctcagaacagtatatagggaagtagtccttgaccaggcagcccaggcgccgctgtgctctcggaggtgctcctggagcagggcgccagggggaagaccgatgggccccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccactgcaccccttcacactggacaccttttaaaatagcagcaaggaaaatccagctcagcccaaactccatggtgagtctctgtgtttcagtcctgatcactgaatgaaaacacctgggaatcccaaggctggggctccctctcccaagagctccccaaacccaaactactcacactaaatcgagcaccgggtcgtgtatatactgtctgatggcgcgagggaggcgatacg

SEQ ID NO: 793336 - DNA, 617 bp, Homo sapiens
  misc_feature: 66316.UNK.UNK.UNK.pb.heavy.1.raw 66316
cccgacacgcttgctagggaccttggagctaaggacgacatattgcctttagacacaggtcgaaggtgacgccttagctaccactgaacgtttaggcggccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccccctatcacccccccacatagcctgcttggggtgtttgagtttacttttatttcgtgttggaatgagttgaacttccgggaagtggagtaatgggtttgtctacttcccctaacccgcaaagtactagttttacgagtggcgttgcaagccatagccagtcacaggtaataaacattccaacgtggcgtaaagattggccgcttgctgtgggcattgcaagctgggttttgcagcattgtgcatgctagacgacaatatgaatctgcggacccctagtggccaagatgccgctagcgggttccgcgcagcttttgacctggaccagggtgcatagccgcccagccttc

SEQ ID NO: 793337 - DNA, 700 bp, Homo sapiens
  misc_feature: 66335.44.27.C05.1.pb.heavy.1.raw 66335
ctatgcgccttgccagccccgctcagacagtatataggaagtagtcttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaatacacggcgtgtcctgaggtctcaggctgttcatttgaagagacactgtgttctcggaattgtctctggagatggtgaatcggccctcaacggaatcaccgtagacttgatttcctccatgaatgacacacctgccacccactccagcccctcgcctggagcctggcggaacccactgcatattccaattatcgaaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaaccttcgatcgcgtctaaatcgagcaccggtcgtgtatatactgtctgatggcgcgagggaggcgatacg

SEQ ID NO: 793338 - DNA, 725 bp, Homo sapiens
  misc_feature: 66348.44.85.H08.1.pb.heavy.1.raw 66348
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacaggaggactcaccatggagtttgggctgagctgggttttcctcgttggctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctgggccaagggaccacggtcaccgtctcctcagcctcccaccaagggcccatcggtcttccccctggcaccctcctccaagagcacctctggggcacagcggccctgggctggcctggtcaaggactacttcctatatactgtctgagcgggctggcaaggcgcatag

SEQ ID NO: 793339 - DNA, 606 bp, Homo sapiens
  misc_feature: 66353.UNK.UNK.UNK.pb.heavy.1.raw 66353
ctatgcgccttgccagcccgctcagacagtatataggaagtagtccttgaccaggcagcccaggccgctgtgcccccagaggtgctcctggagcagggcgccagggggaagaccgaatgggcccttggtggaagctgaggaaccggtgaccgtgggtccctttgccccagacgtccagatggtaagacttataatacagaaaccagctgtttcttcccgcattacccgtgcacagtaatatgtgcctgtgtccgcagggggtccatgttgttcatactaaagaccacctgccttttggaggtgtccttgagatggttaaactgctcttcagacgatgtactgtaggattttcgtcattcgagaagatgtgtgcaagccactccaggccttccctggggctgacggatccaggctcacacccattctatatcgtgatgaggagaaccagagatggtgcaggtcagcgtggggtctctgtgggtttcaccagcacaggaccagactccttcaatgcgtgacctgggacaagacccaggagatcgtgcgcagctaaatcgagcaccgtgtccgtatatactgtctgatggcgctaggaaggcgcatacg

SEQ ID NO: 793340 - DNA, 731 bp, Homo sapiens
  misc_feature: 66354.44.33.C11.1.pb.heavy.1.raw 66354
tatgcgccttgccagcccgctcagacagtatataggaagtagtccttttgaccaggcagcccagggccgctgtgccccagaggtgctcttggaggagggtgccagggggaagaccgatgggcccttggtggaggctgaggagacggcgaccgtggtccttggccccaggcgtccataccattggagtagagcatgtcatatctgtatccacgagccccatctctcgcacagtagtagacagccgtgtcctcggctctcaaggctattcatttccagatatagtgtgttcttcgaattgtctctggagatggtgaaatcggcccttcacggaatctacataaatatttattacttccatcataccatataagttgccacccactccagtcccttgcctggagcctggcggacccagtgcatgccatgtctgttgaaggtgaatccagaacgctacacaggagagtctcagggacctccaggctggacacgcctccccagactcaccagcttcacctgacaactggacacctcttaaaagagcaacgaggaaaacccaggtcagcccaaactccatggtgagtcctctgtgttcggtgctgaatcaccgactggaaacaccgcccgacttctggtgctgggctcctctcccagcccaaacccaacgagctcactctaaaatcgagcaccggtcgtgtatatactgtctgaatggcgccgagggaggcgatacg

SEQ ID NO: 793341 - DNA, 684 bp, Homo sapiens
  misc_feature: 66355.UNK.UNK.UNK.pb.heavy.1.raw 66355
ctatgcggccttgccagcccgctcagacagtatataggaagtagtccttgaccaggcacggccagggccgctgtgctcctcggaggtgctctggagcaggcgccagggggaagaccgatgggcccttggtggaggctgaggagacggtgaccagggctcccctggcccaggtagaacgatgggctcgtacaataatagagagccgagtcctcggctctcaaattgttcatttgtagatacacggtgttcttggaattgtctctggagacggagaaatcggcccttcacggagtttccatagtattctttacttccatcagaccagatgactgccacccactccagcccctttgcctggagcctggcggacccagtgcatggcagagtcactgaaactgagtccggacgcaacacaggagagtctcaggacgtccaggctggaccacgcctcccccagactccaccagctgaacctgacactggacacctcttaaaagagcaacgaggaaaacccagctcagcccaaactcccatggtgagtctctgtgttcagtgctgatcaccgaatggaaacaccgccgacttctagtgctgggctccctctccagcccctttcccttactgactcactaaatcgagcacggtcgtgtatatactgtctgatggcgcgagggaggcgatacg

SEQ ID NO: 793342 - DNA, 575 bp, Homo sapiens
  misc_feature: 66356.UNK.UNK.UNK.pb.heavy.1.raw 66356
ctatgcgccttgccagcccgctcagacagtatataggaagtagtccttgaccaggcagcccagggccgctgtgctctcggaggtgctcctggagcagggcgccagggggaagaccgatgggccccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtggctcctggtcatactaactctgccttggaacttctgggcaaagcccgtgtgccactatagggcttcatccatccccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaactcggcacccaaacccaaactactcacactaaatcgagcaccgggtcgtgtatatactgtctgatggcgcgagggaggcgatacg

SEQ ID NO: 793343 - DNA, 604 bp, Homo sapiens
  misc_feature: 66358.UNK.UNK.UNK.pb.heavy.1.raw 66358
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggggatgggataggaaatagaatccacccctatcacccccccacatagcctgcttggggtgttgagtttacttttatttcgtgttggaatgagttgaacttccgggaagtgagtaatgggtttgtctacttcccctaaccgcaagtactagtttacgagtggcgttgcaagccatagccagtcacagtaataaacaattcaacgtggcgtaaagattggccgcttgctgtgggcattgcaagctgggtttgcagcattgtgcatgctagacgacaatatgaatctgcgggacccctagtggccaagatggccgctagcggttccgcagcttttgacctggaccagggtgcatagcctgcccagccttc

SEQ ID NO: 793344 - DNA, 634 bp, Homo sapiens
  misc_feature: 66372.UNK.UNK.UNK.pb.heavy.1.raw 66372
cgtatcgcctccctcgcgccatcagacagtatatacacgaccggtgctcgattagtagtctcataagggaaatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcggaaccctgtctctcatctgcactgtctctggagtttccatcagttctgatcattcttggggctggatccggcagccccagggaggggaatggagtggattggtgacatccattatactggggcgacgtactacctccgtccctcaagtcgtctcaccatttcgagggacacgtccatgaaccgcttctccctgaaactgacctccgtgacgcgcggacacggccgtttatttctgtgcgaggcgagactggtctttcaatctatgggccgtggcaccctggtcactgtctcctcagcttccacaaggcccatcggtcttcccctggcgccctgctccaggagcacctctggggcacagcggccctggctgcctggtcaaggactacttcctatatactgtctgagcgggctggcaaggcgcatag

SEQ ID NO: 793345 - DNA, 645 bp, Homo sapiens
  misc_feature: 66388.44.86.H09.1.pb.heavy.1.raw 66388
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggcccatagattgaaagaccagtctcgcctcgcacagaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctggggctgccggatccagcccaagaatgatcagaactgatggaaactccagagacagtgcagatgagagacagggttcccgaaggcctcaccagtcctgggccgactcctgcagctgcacctggacaggacccatctgggagctgccaccagcaggaggaaaaaccacaggtgcttcatgttcttgcacaggaggtccttgactctcagaaagcatccccaaaccaagtctatagcactaaatcgagcaccggtcgtgtatatactgtctgatggcgcgagggaggcgatacg

SEQ ID NO: 793346 - DNA, 587 bp, Homo sapiens
  misc_feature: 66451.UNK.UNK.UNK.pb.heavy.1.raw 66451
acccgacacgcttgctagggacttggagctaaggacgacatattgcctttagacagtcgaagggacgccttagctaccactgaacgtttaggcgccagatggcggtctgggatgacctaactcgcagcttatcgatgatctactgcacgctcaccaaccaggtcttgaatgcgcgcgagatgacgggatcgctacagacatttaactcgctagtaacttaattgagatcctagggggatgatggaaattgaatccacccctatcaccccccacatagcctgctgggttgttgagttactttatttcgtgttggaatgagttgaacttccgggaagtgggagtaatgggtttgtctacttcccctaaccgcaaagtactagtttacgagtggcgttgcagcataagccagtcacaggtaataacaaattcaacgtggcgtaaagattgggccggcttgcgggcattgcaagctgggtttgcagcattgtcatgctagacaacaatatgaatctgcgggaccctagtgccaagatgccgctaggggttcgcagcttttgactggaccaggtgctagcctgcccagctct

SEQ ID NO: 793347 - DNA, 677 bp, Homo sapiens
  misc_feature: 66477.UNK.UNK.UNK.pb.heavy.1.raw 66477
cgtatcgcctccctcgcgccatcagacagtatatacacgacccggtgctcgattttgatcacataacaaccacactcctcctctaaagaaggcccctgggagcacagctcatcaccatggactggactggcggttcctctttgtggtggcagcagctacaggtgtccagtcccaggtgcagctggtgcagtctggggctgaggtgaagaagcctggtcctcggtgaaggtctcctgcaaggcttctggaggcaccttcttcagctatgcttttatttgggtgcgacaggccctggacaagggcttgagtggctgggagggatcatccctatctttggtgcatcgaattacgcacagaagtttcaggacagagtcaccattaccgcggacgaatccacgagtacagcctacatggagctgagcaggctgagatctggaagacaccggccatctatttctgtgcgagagcccctcgtcaactttcatagtccctctcatagtcccacacatggaaattggttcgacccctggggccagggaaccctggtcaccgtctcctcagcttccaccaagggccatcggtcttcccctggcgccctgctccagggcacctctgggggcacagcggccctgggctgcctggtcaaggactacttcctatatactgtctgagcgggc

SEQ ID NO: 793348 - DNA, 702 bp, Homo sapiens
  misc_feature: 66497.44.67.G01.1.pb.heavy.1.raw 66497
ctatgcgccttgccagccgctcagacagtatataggaagtagtccttgaccaggcagcccagggccgctgtgcccccagaggtgctcttggaggagggtgccagggggaagaccgatggggcccttggtggagcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttcctggagcctggcgaccccaactcatgtagttgctgctgacggtgagcccagaggctgcacaggagagtctctgggaccccccaggctggactaagcctcctccagactccatcagccgcacctcacactggacacccttttaaaagtccaacaaggagaaaccagctcagccaaaactccatggtgagtcctctgtgttcagtgctgatcacgaatggaaacacctcggaatcccagtgctgggctctctcccccccaaacccaatatgtatactctaaatcgagcaccggtcgtgtataactgtctgatggcgcgggaggacgatacg

SEQ ID NO: 793349 - DNA, 712 bp, Homo sapiens
  misc_feature: 66504.UNK.UNK.UNK.pb.heavy.1.raw 66504
cgtaatcgcctccctcgcgccatcagacagtatatacacgacggtgctcgatttagctgcgtcacgatctctcttgggagctctcagagaggtggccttagccctggattccaaggcatttccacttggtgatcagcactgaacacagaggactcaccatggagttggggctgcgctgggttttccttgttgctattttagaaggtgtccactgtgaggtgcggctggtggagtctgggggaggcttggtacagcggggggggtccctgagactctcctgtgcagctctggattcatcttcagtgactatgccatggactggtccgccaggctccagggaaggggctggagtgggtttcatatgttaatattgctggagaataccacctactacgcagactctgtgaagggccgattcaccaattccaggggacaatgccaagaactcactgtatctggaaatgaacagcctgagagacgaggacacggctgtctacttctgttcgagagatcgggccacttggtccagtggctggttttgactactggggccggggaaccctggtcaccgtctcctcagcctccaccaagggcccatcggtcttcccctgggcgccctgctccaggagcacctccgagagcacagcggccctgggctgcctggtcaaggactacttcctatatactgttctgagcgggctggcaaggcgca

SEQ ID NO: 793350 - DNA, 564 bp, Homo sapiens
  misc_feature: 66516.44.36.D03.1.pb.heavy.1.raw 66516
cgtatcgcctccctcgcgccatcagacagtatatacacgaccggtgctcgatttagctgcgtcacgatctctcttggggacccagcttctgatgactctcctgttgccagcgtccatggcctcagtgaaggtctctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatgggagctgagcagtcagagatctgaggacatagatgtgtactactgtgcgagaccggtagaggacaagcaagaaaagaagttcttttgactactggggccagggaaccctggtcaccgtctcctcagcctccaccaagggccatcggtcttccctggcacctcctccaagagcacctctggggcacagcggccctgggctgcctggtcaaggactacttcctatatactgtctgagcgggctggcaaggcg

SEQ ID NO: 793351 - DNA, 648 bp, Homo sapiens
  misc_feature: 66533.UNK.UNK.UNK.pb.heavy.1.raw 66533
ctatgcgccttgccagcccgctcagacagtatataggaagtagtccttgaccaggcagcccaggcccgctgtgcccccagagtgctctggagcagggcgccaggggaagaccgatgggccttggtgaagctgaggagacagtgaccagggtgccacggccccatagattgaaagaccagtctcgcctcgcacagaaataaacggccgtgtccgcggcggtcacggaggtcagtttcagggagaagcggttcatggacggtccctcgaaatggtgagacgactcttgaggacggagatagtacgtcgccccagtatataatggatgtcaccatccactccattcccctccctgggggctgccggatccagccccaagaatgatcagaactgatggaaactccagagaacagtgcagggagaagacagggttcccgaagcctcaccagtctgggcccgactcctgcagctgcactgggacaggacccatctgggagctgccaccagcaggaggaaaaaccacagtgctgtcatgttcctgcacaggattgtcctgacgtctcagaaagcatccccaaacccaagtctatagcactaatcgagcaccggtcggatgtatacctgtctgatggcgcggagggaggcgatacg

SEQ ID NO: 793352 - DNA, 697 bp, Homo sapiens
  misc_feature: 66547.44.27.C05.1.pb.heavy.1.raw 66547
ctatgcgccttgccagcccgctcagacgtatataggaagtagtcctgaccaggcagcccagggccgctgtgctctcggaggtgctcctggagcagggcgccagggggaagaccgatgggcccttggtgaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctgcggacccactgcatattccaattatcgaaggtgaatccagaggctgcacaggagagtctcaggacccccctactgggccacgcctcccccagactccacgaattgcactgacacatgacacctcttaagagggcaacgaggaaaacccagctcagcccaactccatggtgagtcctctgtgtttcagtgatgatcaccgagtggaaacaccggcgacttccagtgctggctcgtctcccaggcccaaacccttcgatcgcgtctaaatcgagcaccggtcgtgtatattactgtctgatggcgcgagggaggcgatacg

SEQ ID NO: 793353 - DNA, 652 bp, Homo sapiens
  misc_feature: 66548.44.86.H09.1.pb.heavy.1.raw 66548
cgtatcgcctccctcgcgccatcagacagtatatacacgaccggtgctcgatttagtgctatagacttggttggggatgctttctgagagtcaaggacctcctgtgcaagaacatgaagcacctgtgggtttttcctcctgctggtggcagctcccagatgggtcctgtcccaggtgcagctggcaggagtcgggcccaggactggtgaggccttcgggaaccctgtctctcatctgcactgtcttctggagtttccatcagttctgatcattcttgggctggatccggcagcccccagggaggggaatggagtggattgtgacatccattatactggggcgacgtactactctccgtccctcaagagtcgtctcaccatttcgaggacacgtccatgaaccgcttctccctgaaactgacctccgtgaccgccgcggacacggccgttatttctggtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793354 - DNA, 704 bp, Homo sapiens
  misc_feature: 66557.44.36.D03.1.pb.heavy.1.raw 66557
ctatgcgccttgccagcccgctcagacagtatataggaagtagtccttgaccaggcagcccagggccgctgtgctctcggaggtgctcctggagcagggcgccaggggaagaccgatggcccttggtggaggctgaggagacggtgaccagggttccctggccccagtggacagttcctgatataaaccaacacaataatacatgcccgtgtcctcggttttcaggttagtcattcgcagaatcaatgagttcttgaagtcatctcttgagagggtgaatctggctttcacacgcagcgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatac

SEQ ID NO: 793355 - DNA, 680 bp, Homo sapiens
  misc_feature: 66560.UNK.UNK.UNK.pb.heavy.1.raw 66560
cgtatcgcctcctcgcgccatcagacagtatatacacaccggtgctcgatttagctacgactgcaagggaaaggggagagaggagccttagcctggactcaaggcctttccacttggtgatcgagcactgagcacagaggactcaccatggaattgggactgagctgggttttccttgttgctattttagaaggtgtccagtgtgaggtgcaactggtggagtctggggagaggcttggtccagcctggggggtccctgagactctcctgtgcagcctctggatcacctttagtagttattggatgaactgggtcgccaggctccaggaagggctggagtgggtggccatcatgaagaaagatggaactgagacacactatgtggactctgtgaagggccgattcaccatctccagagacaacgcaagaactcactgtatctgcaaatgacagtctgagagtcgaggacacgggctgtgtattattgtgcgggaggcgctggtggctcattgatactgggtcagggaaccctggtcaccgtctcctcagctccaccaagggcccatcggtctttccccctggcgccctgctccaggagcacctccgagagcacagcggccctggctgcctggtcaaggactacttcctatatactgtctgagcggctgcaaggcgcatag

SEQ ID NO: 793356 - DNA, 698 bp, Homo sapiens
  misc_feature: 66570.44.36.D03.1.pb.heavy.1.raw 66570
ctatgcgccttgccagcccgctcagacagtatataggaagtagtccttgaccaggcagccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctgggcggacccagtccataatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctccccaagagagatcgtgacgcagctaaatcgagcaccggtcgtgtatatactgtctgatggcgcgagggaggcgatacg

SEQ ID NO: 793357 - DNA, 609 bp, Homo sapiens
  misc_feature: 66596.UNK.UNK.UNK.pb.heavy.1.raw 66596
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatccccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 793358 - DNA, 698 bp, Homo sapiens
  misc_feature: 66599.44.55.E11.1.pb.heavy.1.raw 66599
ctatgcgccttgccagcccgctcagacagtatataggaagtagtccttgaccagcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcgaatcccagtgctgggctcctctccccaaacccaacgtgcgagtgctaaatcgagcaccggtcgtgtatatactgtctgatggcgcgaggaggcgatacg

SEQ ID NO: 793359 - DNA, 705 bp, Homo sapiens
  misc_feature: 66607.44.36.D03.1.pb.heavy.1.raw 66607
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgttgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793360 - DNA, 699 bp, Homo sapiens
  misc_feature: 66624.44.36.D03.1.pb.heavy.1.raw 66624
ctatgcgccttgccagcccgctcagacagtatataggaagtagtccttgaccaggcagcccagggccgctgtgctctcggaggtgctcctggagcagggcgccagggggaagacgatgggcccttggtggaggctgaggagacggtgaccagggttccctggccccagtggacagttcctgatataaacacaacacaataatacatgcccgtgtcctcgggttttcaggttagtcattcgcagaatcaatgagttcttgaagtcatctcttgagagggtgaatctggctttcacagacgcggcgtactctgtgataaagctggcaacttgttttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgcgagggaggcgatacg

SEQ ID NO: 793361 - DNA, 697 bp, Homo sapiens
  misc_feature: 66642.UNK.UNK.UNK.pb.heavy.1.raw 66642
ctatgcgccttggccagcccgctcagacagtatataggaagtagtcccttgaccaggcagcccagggccgctgtgctctcgaggtgctcctggagcagggcgccagggaagaccgatggcccttggtggaggctgaggagacggtgaccagggttccctggcccagtggacagttcctgatataaacacaacacaataatacatgcccgtgtcctcggtttcaggttagtcattcgcagaatcaatgagttcttgaagtcatctcttggagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaacccagctcagcccgaactccatggtgagtcctctgtgttcagtgctgatcaccaaatgaaaacacctgggaattctgggctggggctccgctctcagagctccccaagagagatcgtgacgcagctaaatcgagcacggtcgtgtatatactgtctgatggcgcgaggaggcgatacg

SEQ ID NO: 793362 - DNA, 735 bp, Homo sapiens
  misc_feature: 66660.UNK.UNK.UNK.pb.heavy.1.raw 66660
tcgtatcgcctccctcgcgccatcagaccagtatattacacgaccggtggctcgatttagtagtcgcataaaggaaaggggagctctgaagaggagcccagcctgggaatttttcaggtgtccttcattttggtgaccagggaccgaacagagagaagtctccatggaggttgggctgagctgcctttttcttgtgcttttttaaagggtgtcgtgtgtgaagtgcagttgttggagtctggggggggcctgattcgcctgggaggtccctggaccctctctcctgtgcggcctctggattcaccttagtgcctatggcatgacctgggttccgccgggctccagggagggggactgagtgggtctcaagtatcggagctggtggtgtcactttcacggagactccgtgaagggcccgcttcaccatttccagggacattcgcaggacaaattgtttctccaaatgaaaaacctgagacccgaggacacaggcgtctattactgtttgaaagccaggaccaaccgggtgaccccccggaccacgcacctttagtacttgggcggcggggcaaccaggtggtgaccgtctcttccagcctccaccaggcccatcggttccccctgacccttggcgccctgctccaggagccacctccgagagcacagcggccctgggctgcctggtcaaggactacttcctatattactgtctgagcgggctggcaaggcgcatag

SEQ ID NO: 793363 - DNA, 591 bp, Homo sapiens
  misc_feature: 66696.UNK.UNK.UNK.pb.heavy.1.raw 66696
cttgccagccgctcagacagtatatggaagtagtccttgaccaggcagcccaggccgctgtgctctcggagtgctcctggagcagggcgccaggggaagacgatggcctgtggaggccgaggagacggtgaccagggttccctgccccaggcgtcgatgaacgattttggaaacagatagtctcgcacaaaaatacacggccgtgtctgaggtctcaggctgttcatttgaagaacactgtgttctcggaattgtcttctgagatggtgaatccggcctcaacggaatcaccggtagacttgatttctccatgaaatgacaccacctgcccccactccagccctcgcctggagcctggcggatcccactgcatattccaattatcgaaggtgaatccagaggctgcacaggagagtctcaggacccccctactggggccacgctcccccagactccacgatttgcacctggacacatgacacctcttaagagggcaacgaggaaaacccagctcagcccaaacccttcgatcgcgtctaaatcgagcaccggtcggttggatatactgtctgatggcgcgaaggcgatacg

SEQ ID NO: 793364 - DNA, 689 bp, Homo sapiens
  misc_feature: 66740.44.74.G08.1.pb.heavy.1.raw 66740
cgtatcgcctccctcgcgccatcagacagtatatacacgaccggtgctcgatttagtagctctatcaggggggcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacctttcctgcacggcctctggaagtactaccagttccactacttataccatcaactgggtgcgccaggccctggacaagggcttgagtggatgggtggaatcatccctctttttggctcactcacctacgcacgagacttccgggcagaattacgattaccgcggacaagtccacagacacagtctccatgacaatgagttctttgaaatccgacgacacgccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgtgggcacagcggccctgggctgcctggtcaaggactacttcctatatactgtctgagcgggctggcaaggcgcatag

SEQ ID NO: 793365 - DNA, 704 bp, Homo sapiens
  misc_feature: 66743.44.55.E11.1.pb.heavy.1.raw 66743
cgtatcgcctcctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793366 - DNA, 715 bp, Homo sapiens
  misc_feature: 66808.44.85.H08.1.pb.heavy.1.raw 66808
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtgagtctggggaggcgtggtccagcctggaggtccctgagactctcctgtgccagcgtctggattcaccttcagtacctatggcatgcactggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtaactaccacctgctgggactactactacgtatggacgcgctggggccaagggaccacggtcaccgtctcctcagcctccaccaagggcccatcggtcttcccctggcaccctcctccaagagcacctctgggggcacagcggcctgggctgcctggtcaaggactacttcctatatactgtctgacggctggcaaggcgcatag

SEQ ID NO: 793367 - DNA, 692 bp, Homo sapiens
  misc_feature: 66823.44.36.D03.1.pb.heavy.1.raw 66823
cgtatcgcctccctcgcgccatcagacagtatatacacgaccggtgctcgatttagctgcgtcacgatctctcttgggagctctgagagcggagccccagcccagaattcccaggtgttttcatttggtgatcagcactgaacagaggactcaccatggagttcgggctgagctgggttttccttgttgttattttacaaggtgtccagagtgaagtgcagtggtggagtccgggggagacttggtccagcctggagggtcctgagactctcctgtgtcgcctctggattcaccatcagtgaccactatatggactgggtccgccaggctccagggaagggctggagtggcttgccgcagtaaaaacaaagttgccagcttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaagggccatcggtcttccccctggcgccctgctccaggagcacctccgagagcacagcgccctgggctgcctggtcaaggactacttcctatatactgtctgagcgggctgcaaggcgcatag

SEQ ID NO: 793368 - DNA, 693 bp, Homo sapiens
  misc_feature: 66842.44.62.F07.1.pb.heavy.1.raw 66842
cgtatcgcctccctcgcgccatcagacagtatatacacgaccggtgctcgatttagtagtcgcataaagggaaaggggagctctgagagaggagcccagccctgggattttcaggtgtcttcatttggtgaccaggaccgaacagagagaagtctccatggagttttgggctgagctgcctttttcttgtggctttttttaaaggggtgtcgtgtgtgaagtgcagttgttggagtctggggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagaccccgaggacacaggcgtctattactgtttgaaaagccaggaccacggtgaccccccccatgacacctttagtacttggcggccggggacagtggtgaccgtctcttcagcctccaccaagggcccatcggtcttccccctggcgccctgctccaggagcacctccgagagcacagcggccctgggctgcctggtcaaggactacttcctatatactg

SEQ ID NO: 793369 - DNA, 609 bp, Homo sapiens
  misc_feature: 66870.UNK.UNK.UNK.pb.heavy.1.raw 66870
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagtttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 793370 - DNA, 717 bp, Homo sapiens
  misc_feature: 66871.UNK.UNK.UNK.pb.heavy.1.raw 66871
cgtatcgcctccctcgcgccatcagacagtatatacacgaccggtgctcgatttagctgcgtccacgatctctcttggggagctctgagagcggagccccagccccagaattcccaggtgttttcatttggtgatcagcactgaacacagaggactcaccatgggagttcgggctgagctgggttttccttgttgttattttacaaggtgtcagaagtgaagtgcagttggtgagtccgggggagacttggtccagcctgcgaggggtccctgaagactctcctgtgtcgcctctggattcaccatcagtgaccactatatggactgggtccgccaggctccagggaaggggctggagtggcttggccgcagtaaaaaaaaggttgccagctttatcacaggagtacgccgcgtctgtgaaagccagattcaccctctcaagagatgacttcaagcactcattgattctgcgaatgactaaactgaaaaccgaggacacggcaatgtattattgtgttgtggtttatatcaggaactgtccactggggccagggaacccctgggtcaccgtctcctcagcctccaccaagggcccatcggtcttttcccctggcgcctgctccaggagcacctccgagagcacagcggccctgggactgcctggtcaaggactacttcctatatacctgtctgagcgggctggcaaggcgcgcatag

SEQ ID NO: 793371 - DNA, 740 bp, Homo sapiens
  misc_feature: 66879.44.56.F01.1.pb.heavy.1.raw 66879
cgtatcgcctccctcgcggccatcagacagtatatacacgaccggtgctcgatttagcagacgtctgaacacacaaaggggagctctgggagaggagccccagccgtgagattcccaggagtttccacttggtgatcagcactgagcacagaccacccaaaaccatggagtttgggctaatcttgatttttccttgtagtttttttagaaggtgtccagtgcgagggcgactggcggagtcggggggggggcttggcacagccaggggcggtctctgagaactctcctgtgtagtctcaggattcagtcttagtgattatcacttggcctggggtccgtcaggctccagggaagggggcttgagtggatcactttcgtcagaatgaaaacgttatggtggaagtaaagagtacgccgcgtctgtgaaggggaagattcaccgtctcaagggatgactccaacagttgttggccatttacaaatgagcaacctgagaacccgacgaccacaggcgtctattactgcgccaggcgatccctgggacggtcgatgcattttgatatttggggcccaggggacaatggtcaaccgtcttcttcagcttccaccaaagggcccatcggtcttccccctggcgccctgctccaggagcacctctgggggcacagcggcccctgggctgcctggttcaaggactacttcctatatactgtttctgagcgggctggcaaggcgcatag

SEQ ID NO: 793372 - DNA, 713 bp, Homo sapiens
  misc_feature: 66885.44.55.E11.1.pb.heavy.1.raw 66885
cgtatcgcctccctcgcgccatcagacagtatatacacgaccggtgctcgatttagcactcgcacgttgggtttggggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactggtgcgagacaagtcggcgctccggagtggttattattcgtttgacttctggggccagggaaccctggtcaccgtcgcctcccgcctcccaccaagggcccatcggtcttcccccctggcaccctctccaagagcacctctggggggcacagcggtcctgggctgcctggtcaaggactacttcctatatactgtctgagcgggctggcaaggcgcatag

SEQ ID NO: 793373 - DNA, 654 bp, Homo sapiens
  misc_feature: 66898.44.23.C01.1.pb.heavy.1.raw 66898
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgcccctgctccaggagcacctctgggggcacagcggccctgggctgcctggtcaaggactacttcctatatactgtctgagcgggctggcaaggcgcatag

SEQ ID NO: 793374 - DNA, 650 bp, Homo sapiens
  misc_feature: 66903.UNK.UNK.UNK.pb.heavy.1.raw 66903
cgtatcgcctccctcgcgcatcagacagtatatacacgaccggtgctcgatttagtacacgtggattaggattgggggcttttctgagagtcaaggacctcctgtgcaagaacatgaagcacctgtggtttttcctcctgctggtggcagctcccagatgggtcctgtccaggtgcagctgcaggagtcgggccaggactggtgaggcccttcgggaaccctgtctctcatctgcactgtctctggagtttccatcagttctgatcattctggggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggttctttcaaatctatggggccgtggcaccctggtcactgtctcctcagcttccaccaagggcccatcggtcttcccctggcgccctgctccagagcacctctgggggcacagcggccctgggctgcctggtcaaggactacttcctatatactgtctgagcgggctggcaaggcgcatag

SEQ ID NO: 793375 - DNA, 683 bp, Homo sapiens
  misc_feature: 66909.44.73.G07.1.pb.heavy.1.raw 66909
cgtatcgcctccctcgcgccatcagacacgaccggtgctcgatttagctctacgctcagggggggagacgagcccagcactggaagtcgccggtgtttccattcggtgatcatcactgaacacagaggactcaccatggactttgggctgagatggtttttcctcgttgctcttttaagaggtggccagtgtcaggtgcagctagtggagtctgggggaggagcggcccagcctggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793376 - DNA, 609 bp, Homo sapiens
  misc_feature: 66934.UNK.UNK.UNK.pb.heavy.1.raw 66934
gaaggctgggcaggctatgcaccctggtccaggtcaaaagctgcggaacccgctagcggccatcttggccactaggggtcccgcagatttcatattgtcgtctagcatgcacaatgctgcaaacccagcttgcaatgcccacagcaagcggccaatcttacgccacgttgaatgtttattacctgtgactggctatggcttgcaacgccactcgtaaaactagtactttgcggttagggggaagtagacaaacccattactccacttcccggaagttcaactcattccaacacgaaataaaagtaaactcaacaccccaagcaggctatgtgggcggggtgataggggtggatctatttcctatcccatccctaggatctcaattaagttactagcgagttaaatgtctgtagcgatcccgtcagtcctatcgcgcgccatcaagacctggttggttgagcgtgcagtagatcatcgataagctgcgagttaggtcatcccagaccgcatctggcgcctaaaacgttcagtggtagctaaggcgtcaccttcgactgtctaaaggcaatatgtcgtccttagctccaagtccctagcaagcgtgtcggg

SEQ ID NO: 793377 - DNA, 687 bp, Homo sapiens
  misc_feature: 66939.44.36.D03.1.pb.heavy.1.raw 66939
cgtatcgcctcctcgcgccatcagacagtatatacacgaccggtgctcgatttagctgcgtcacgatctctcttggggagagcggagccccagccccagaattccaggtgttttcatttggtgatcagcactgaacacagaggactcaccatggagttcggctgagctgggttttccttgttgttattttacaaggttccagagtgaagtgcagttggtggagtccgggggagacttggtccagcctggagggtcccctgagactctcctgtgtcgcctctggattcaccatcagtgaccactatatggactgggtccgccaggctccagggaaggggctggagtggcttgccgcagtaaaaacaaagttgcagcttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggcaggaaccctggtcaccgtctcctcagctccaccaaggcccatcggtcttccccctggcgccctgctccaggagcacctccgagagcacagcggccctgggctgcctggtcaaggactacttcctatatactgtctgagcgggctggcaaggcgcatag

SEQ ID NO: 793378 - DNA, 676 bp, Homo sapiens
  misc_feature: 66956.44.53.E09.1.pb.heavy.1.raw 66956
ctatgcgccttgccagcccgctcagacagtatataggaagtagtccttgaccaggcagcccagggccgctgtgctctcggaggtgctcctggagcaggcgccaggggaagaccgatgggccttggtggaggctgaggagacggtgaccaggtttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagcccttccctggagcctggcggacccaggtcatccaggcgttactgaaagtgaatccagaggctgcacaggagagtctaagggactcccaggctttaccaaacctcccccagactccaccaactgcacctcacactggacaccttttaaaatagcagcaaggaaaatccagctcagccaaactccatggtgagtcctctgtgttcagtcctgatcactgaatgaaaacacctgggaatcccaaggctgggctcctctcccagagctcaacacactctctctaaatcgagcaccggtcgtgtatatactgtctgatggcgcgagggaggcgatacg

SEQ ID NO: 793379 - DNA, 708 bp, Homo sapiens
  misc_feature: 66983.44.36.D03.1.pb.heavy.1.raw 66983
ctatgcgccttgccagcccgctcagacaagtatataggaagtagtcctttgaccaggcagcccaggggccgctgtgctctcggaggtgctccctggagcagggcgccaggggaagaccgatgggccttggtggaggctgaggagacggtgaccagggttcccggccccagtagtcaaaaccagccactgaccaagtggcccgatctctcgaacagaagtagacagccgtgtcctcgtctctcaggctgttcatttccagatacagtgagtttctggcattgtccctggaattggtgaatcggcccttcacagagtcgcgtagtaggtggtatctccagcaatattaacatatgaaacccactcagcccttccctgggagcctggcggacccagttcatggcatagtcactgaagatgaatccagaggctgcacaggagagtctcaggacccccccgctgtaccaagcctccccagactccaccagccgcacctcacagtggacaccttctaaaatagcaacaaggaaaacccagcgcagccccaactccatggtgagtcctctgtgttcattgctgatcaccaagtggaaatgccttggaatccagggctaaggcacctctctgagagctcccaagagagatcgtgacgcagctaaatcgagcaccggtcgtgtatatactgtctgatggcgcgagggaggcgatacg

SEQ ID NO: 793380 - DNA, 646 bp, Homo sapiens
  misc_feature: 66984.44.12.B01.1.pb.heavy.1.raw 66984
ctatgcgccttgccagcccgctcagacagtatataggaagtagtccttgaccaggcagccaggccgctgtgcccccagaggtgctcttggaggagggtgccagggaagacgatggccttggtggaggctgaggagacggtgacagggttccctgcccagtggtcaaagtagttggtgacgaactgcccctactctcgcacagtaatacacggccgtgtccgcggcggtcacagagctcagcttcaggagaactggttcttggacgtgtctactgatatggtgactcgactctttgaggacgggttgtagtaggtgctcccactataatagatactccaatccactccagccccttccctgggggctggcggatccagcccagtagtaactactactgctgatggagccaccagagacagtgcaggtgaggacagggtctccgaaggcttcaccagtcctggcccgactcctgcagctgcagctggacaggacccatctgggagccgccaccagcaggaggaagaaccacaggtgctcatgttcttgcacagaggtccatgactctcagaaagccccgcggaatctacactactaaatcgagcaccggtcgtgtatatactgtctgatggcgcgaggaggcgatacg

SEQ ID NO: 793381 - DNA, 654 bp, Homo sapiens
  misc_feature: 66990.44.86.H09.1.pb.heavy.1.raw 66990
cgtatcgcctcctcgacgccatcagacagtatatacacgaccggtgctcgatttagtgctatagacttgggtttggggatgctttctgagagtcaagacctcctgtgcaagaacatgaagcacctgtgtttttcctcctgctggtggcagctcccagatggtcctgtcccaggtgcagctgccaggagtcgggcccaggactggtgaggccttcggaaccctgtctctcatctgcactgtctctggagttttccatcagttctgatcattcttggggctggatccggcagccccccaggaggggaatggagtggattggtgacatccattatactgggggcgacgtactactctcccgtccctcaaagagtcgtctcaccatttcgagggacacgtccatgaaccgcttctccctgaaactgacctcctgaccgcgcggacacggccgtttatttctgtgcgaggcgagactggtctttcaatctatggggccgtgcaccctggtcactgtcttcctcagcttccaccaagggcccatcggtcttccccctggcgccctgctcaggagcacctctgggggcacagcggccctggctgcctggtcaaaggactacttccctatatactgtctgagcgggctggcaaggcgcatag

SEQ ID NO: 793382 - DNA, 706 bp, Homo sapiens
  misc_feature: 67049.44.70.G04.1.pb.heavy.1.raw 67049
ctatgcgccttgccagcccgctcagacagtatataggaagtagtccttgaccaggcagcccagggccgctgtgctctcggaggtgctcctggagcagggcgccagggggaagacgatgggcccttggtggaggctgaggagacggtgaccagggtcccctggccccagtcatgcgcccggtaataactactaccacctcccgatctcgcacagtaatacagagccgagtcctcgactctcaggctgaccatttccaagtacacaatgttcgggaattgtctctggagatggtgaatcggcccttcacggagtctgcataatattcagaacttccatcatgtgctataactgccaaccactccggccccttgcctggagcctggcggacccagtgcatgccagaaccactgaaactaaatccagaggcttcacaggagagtctcagggacctccaggctggaccacgcctcccccagactccaccaggtgcacctgacagtggacacctcttaaaagagcaacgaggaaaacccagctcagcccaaactccatggtgagtcctctgtgttcagtgctgatcaccgaatggaaacaccgccgacttctagtgctgggctcctctcccagacccctttccttcacactacactaaatcgagcaccggtcgtgtatatactgtctgatggcgcgcgagggaggcgatacg

SEQ ID NO: 793383 - DNA, 694 bp, Homo sapiens
  misc_feature: 67065.44.36.D03.1.pb.heavy.1.raw 67065
cgtatcgcctccctcgcgccatcagacagtatatacacgaccggtgctcgatttagctgcgtcacgatctctcttgggggagctctgagagcggagccccagcccagaattccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaagggctggagtggcttggccgcagtaaaaacaaagttgccagctttatcacagagtacgccgcgtctgtgaagccagattcaccctctcaagagatgacttcaagaactcattgattctgcgaatgactaacctgaaaaccgaggacacggcatgtattattgtgttgtgtttatatcaggaactgtccactggggccagggaaccctgtcaccgtctcctcagcctccaccaagggcccatcgtcttcccctggcgccctgctccaggagcacctccgagagcacagcggccctggctgcctggtcaaggactacttcctatatactgtctgagcgggctgcaaggcgcatag

SEQ ID NO: 793384 - DNA, 640 bp, Homo sapiens
  misc_feature: 67101.44.23.C01.1.pb.heavy.1.raw 67101
ttatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcgttcatggacgtgtccctcgaaatggtgagacgactcttgagggacggagagtagtacgtcgccccagtataatggatgtcaccaatccactccattccctccctggggctgccggatccagcccaagaatgatcagaactgatggaaactccagagacagtgcagatgagagacaggttcccgaaggcctcaccagtcctggccgactctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatactgtctgatggcgcgaggaggcgatacg

SEQ ID NO: 793385 - DNA, 684 bp, Homo sapiens
  misc_feature: 67103.44.74.G08.1.pb.heavy.1.raw 67103
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccttcctgcacggcctctggaagtactaccagttccactacttataccatcaactgggtgcgccaggcccctggacaagggcttgagtggatgggtggaatcatcctctttttggctcactcacctacgcacgagacttccgggcagaattacgattaccgcggacaagtcacagacacagtctccatgacaatgagttcttgaaatccgacgacacggccgtctactactgtgcgagagtccgtaccccagctcgcatgagcctttgagatctgggggcagggaaccctggtcattgtcacctcagcttccaccaagggcccatcgtcttcccctggcgccctgctccaggagcacctctggggcacagcggccctgggctgcctggtcaaggactacttcctatatactgtctgagcgggctggcaaggcgcatag

SEQ ID NO: 793386 - DNA, 699 bp, Homo sapiens
  misc_feature: 67105.UNK.UNK.UNK.pb.heavy.1.raw 67105
ctatgcgccttgccagcccgctcagacagtatataggaaggtagtccttgaccaggcagcccagggccgctgtgccccagagtgctcctggagcaggcgccagggggaagaccgatgggcccttggtggaagctgaagagacggtgaccattgtcccctggccccaaatatcaaatgcatcgacgtccaggatcgcctggcgcagtaatagacgcctgtgtcgtcgggtctcaggttgcctcatttgtaaatggccaacactgttggagtcatccttgagacggtgaatctcccttcacagacgcggcgtactctttacttccacataacgttcattctgacgaaagtgatcactcaagccccttccctggagcctgacggacccaggccaagtgataatcactaagactgaatcctgagactacacaggagagtctcagagaccgccctggctgtgccaagccccccccgactcgccagtcgccctcgcactggacaccttctaaaaaaactacaaggaaaatcagattagcccaaacccatggttggtggtctgtgctcagtgctgatcaccaagtggaaactcctgggatctcacggctgggctcctctcccagagctcccctttgtgtgttcagacgtctgctaaatcgagcacggtcgtgtatatactgtctgatggcgcgaggaggcgatacg

SEQ ID NO: 793387 - DNA, 688 bp, Homo sapiens
  misc_feature: 67113.44.71.G05.1.pb.heavy.1.raw 67113
cgtatcgcctccctcgcgccatcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtgatcactttcgtcagaatgaaacgttatggtggaagtaaaagagtacgccgcgtctgtgaagggaagattcaccgtctcaaggatgactccaacagtgtggccatttacaaatgagcacctgagacccgacgacacaggcgtctattactgcgccaggcgatcctgggacgtcgatgcatttgatatttggggccaggggacaatggtcaccgtcctcttcagcttcccaagggcccatcggtcttccccctggcgccctgcccaggagcacctctgggggcacagcggcctgggctgccttggtcaaggactacttcctatatactgtctgagcgggctggcaggcgcatag

SEQ ID NO: 793388 - DNA, 614 bp, Homo sapiens
  misc_feature: 67124.44.38.D05.1.pb.heavy.1.raw 67124
cgtatcgcctccctcgcgccatcagacagtatatacacgaccggtgctcgatttagtatctgatagctgggttttccttgttgctattttaaaaggtgtccagtgtgaggtgcagctggtggagtccgggggaggcttagttcagcctggggtccctgagactctcctgtgcagcctctggattcaccttcagtagctactggatgcactgggtccgccaagctccagggaaggggctggtgtgggtctcacgtattaatagtggatgggagtagcacaagctacgcggactccgtgaagggccgattcaccatctccagagacaacgccaagaacacgctgtatctgcaaatgaacagtctgagagccgaggacacggctgtgtattactgtggcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcg

SEQ ID NO: 793389 - DNA, 706 bp, Homo sapiens
  misc_feature: 67125.44.27.C05.1.pb.heavy.1.raw 67125
cgtatcgcctccctcgcgccatcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaggcgcatag

SEQ ID NO: 793390 - DNA, 713 bp, Homo sapiens
  misc_feature: 67131.44.33.C11.1.pb.heavy.1.raw 67131
cgtatcgcctccctcgcgccatcagacagtatatacacgaccggtgctcgatttagagtgagctcgttgggtttgggagctctgggagaggagcccagcaccagaagtcggcggtggtttccagtcggtgatcagcaccgaacacagaggactcaccatggagtttgggctgacctgggttttcctcgttgctcttttaagaggtgtccagtgtcaggtgaaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcggc

SEQ ID NO: 793391 - DNA, 646 bp, Homo sapiens
  misc_feature: 67134.44.86.H09.1.pb.heavy.1.raw 67134
ctatgcgccttgccagcccgctcagacagtatataggaaagtagtccttgaccagcagccccagggcgccgtgccccagaggtgctctggagcagggcgccaggggaagacgatggccccttggtgggagctgaggggacagtgccaggggtgcacggcccatagattgaaagacccagtctcgcctcgcacagaaataacggcgtgtccgcggcggtcacggaggtcagttcagggagaagcggttcatggacgttgtccctcgaaatggtgagacgactcttgagggacggagagtagtacgtcgccccagtataatggatgtcaccaatccactccattcccctccctgggggctgccggatccagccccaagaatgatcagaactgatggaaactcagagacagtgcagatgagagacagggttcccgaagggcctcaccagtcctgggcccgactcctgcagctgcacctgggacaggacccatctgggagctgccaccagcagggaggaaaaccacaggtgcttcatgttcttgccacagaggtccttgactctcagaagcatcccaaacccaagtctatagcactaaatcgagcaccggtcgtgtatatactgtctgatggcgcgagggaggcgatacg

SEQ ID NO: 793392 - DNA, 620 bp, Homo sapiens
  misc_feature: 67142.44.38.D05.1.pb.heavy.1.raw 67142
cgtatcgcctccctcgcgccatcagacagtatatacacgaccggtgctcgatttagtatctgatagctgggttttccttgttgctattttaaaggtgtccagtgtgaggtgcagtggtggagtcgggggaggcttagtttttcagcctggggggtccctgagactctcctgtgcagcctctggattcaccttcagtagcctaactggatgcactgggtcgccaagctccagggaagggctggtgtggtctcacgttattaatagtgatgggagtagcacaagctacgcggactccgtgaagggcgattcaccatctccagagacaacgccaagaaacacgctgtatctgcaaagaacagtctgagagccgaggacacggctgtgtattactgtgcaagagccggtgcggggttcggggagttgcatactactactacggtatggacgtctgggggccaaggaccacggtcaccgtctcctcaggcttccaccaagggccccatcggtcttccccctggcgccctggctccaggggcaccttcgggggcacagcggccctgggctgcctggtcaaggactacttcctatatactgtctgagcgggctggcaaggcgcatag

SEQ ID NO: 793393 - DNA, 690 bp, Homo sapiens
  misc_feature: 67148.44.85.H08.1.pb.heavy.1.raw 67148
gagttataggaagtagtccttgaccaggcagcccagggccgctgtgcccccagaggtgctcttggaggagggtgccaggggaagaccgatgggcccttggtggagggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgcggctcctctcccccccgcgactgagtgatactaaatcgagcaccggtcgtgtatatactgtctgatggcgcgagggaggcgatacg

SEQ ID NO: 793394 - DNA, 714 bp, Homo sapiens
  misc_feature: 67149.44.55.E11.1.pb.heavy.1.raw 67149
cgtatcgcctccctcgcgccaatcagacagtatatacacgaccggtgctcgatttagcactcgcacgttgggtttgggggagagggagccccagcactgggattccgaggtgtttccattcggtgatcagcactgaacacagaggactcaccatggagttttgggctgagctgggttctccttgttggacttttaaaaggtgtccagtgtgagggtggcggctgatggagtctggaggagcttagtccagcctgggggtcccagagactctcctgtggcagcctctgggctcaccgtcagcagcaactacatgagttgggtccgccaggctccagggaaggggctggagtgggtctcgagtccatttatactggtgatttcacatactacgcagactccgtgaagggccgattcaccatctccagggacaattccaggacaccggttttatcttccaaatgaacaacctgagaggcgacgacacggccgtctattactgtgcgaagacaagtcggcgctcgggagtggttatattcgtttgacttctggggccagggaaccctggtcaccgtcgcctccgcctccaccaagggcccatcggtcttccccctggcaccctcctccaaagagcacctctgggggcacagcggccctgggctgcctggtcaagactacttcctatatactgtctgagcgggctggcaaggcgcatag

SEQ ID NO: 793395 - DNA, 702 bp, Homo sapiens
  misc_feature: 67160.44.55.E11.1.pb.heavy.1.raw 67160
atgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 793396 - DNA, 685 bp, Homo sapiens
  misc_feature: 67166.UNK.UNK.UNK.pb.heavy.1.raw 67166
cgtatcgcctccctcgcgccatcagacagtatatacacgaccggtggctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaaacgcctggatgacctgggtccgccaggctccaggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaaacaccgaggacacagccgtctattactgtctggatggttttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793397 - DNA, 693 bp, Homo sapiens
  misc_feature: 67167.44.27.C05.1.pb.heavy.1.raw 67167
ctatgcgccttgccagccgctcagacagtatataggggggggaagtagtccttgaccaggcagcccaggccgctgtgctctcgaggtgctcctggagcaggcgccagggaaagaccgatgggcccttggtggagccgagagacggtgaccagggttccctggccccaggcgtcgaatgaccgattttgaaacagatagtctcgcacaaaaatacacgccgtgtcctgaggtctcaggctgttcattgaagagacactgtgttctcggaattgtctctggagatggtgaatcggccctcaacggaatcacgctagacttgatttcctccatgaaatgacacacctgccacccactccagccctcgcctggagcctggcggacccactgcatattccaattatcgaaggtgaatccagaggctgcacaggagagtctcaggacccccctactggggccacgcctcccccagactcacgaattgcacctgacacatgacacctcttaagagggcaacgagaaaaccagctcagcccaactccatggtgagtcctctgtgttcagtgatgatcacgagtggaaacacggcgacttccagtgctggctcgtctcccagggctccccaaacccttcgatcgcgtctaaatcgagcaccggtcgtgtatatactgtctgatggcgcgaggaggcgatacg

SEQ ID NO: 793398 - DNA, 719 bp, Homo sapiens
  misc_feature: 67171.44.62.F07.1.pb.heavy.1.raw 67171
ctatgcgccttgccagcccgctcagacagtatataggaagtagtccttgaccaggcagcccagggccgctgtgctctcggaggtgctcctggagcagggcgccaggggaagaccgatgggcccttggtggaggctgaagagacggtcaccactgtcccccggccccaagtactaaaggtgtcatgggggggtcaccgtggtccctggctttcaaacagtaatagacgcctgtgtcctcggggtctcaggtttttcatttggagaaaacaatttgtcctgcgaattgtccctggaaatggtgaagcggcccttcacggagtctccgtagaaagtgacaccaccagctccgatacttgagaccccactccagtcccctcctggagcccggcggacccaggtcatgccataggccactaaaggtgaatccagaggccgcacaggagagggtcagggacctcccaggccgaatcaggccccccccagactccaacaactgcacttcacacacgaacaccctttaaaaaagccacaagaaaaaggcagctcagcccaaactccatggagacttctctcctgttcggtcctggtcaccaaatgaagacacctgaaaatcccagggctgggctcctctctcagagctcccctttccctttatgcgactactaaatcgagcaccggtcgtgtatatactgtctgatggcgccgagggaggcgatacg

SEQ ID NO: 793399 - DNA, 750 bp, Homo sapiens
  misc_feature: 67179.UNK.UNK.UNK.pb.heavy.1.raw 67179
ctatgcgccttgccagcccgctcagacagtatataggaagtagtcttgaccaggccagcccagggccgctgtgcccccagaggtgctcttggagcggggtgcccagggggaagaccgatgggccctggtggaggctgaggagacggcgaccgtggtccttggccccaggcgtccataccattggagtagagcatgtcatatctggtatccacgagccccatctctccgcacagtagtagacagccgtgtcctcggcctctcagggctattcatttccgatatagtgtgttcttcgaattgtctctggagatggtgaatcggccctctccggaatctacataaatttttactgtgcttcatctaccatatacagttgcccaccccccactgcccagtcccttgcctggagcctggcggacccagtgcatgccatcgttctgttgaaggtgacatccagacgcctacacaggagagtctcagggacctcccaggctggaccacgcctcccccagactccaccagcttcacctgacactggacacctcttaaagagcaacgaggaaaacccaggtcagcccaaactccatggtgagtcctctgtgttcgggctgcgctgatcaccgactggaaacaccgccgacttctggtgctggggcctcctctcccagagctccccaacccaagtctatagcactaaatcgacgcaccggtcgtgtatatactgtctgatggcgcgagggaggcgatacg

SEQ ID NO: 793400 - DNA, 708 bp, Homo sapiens
  misc_feature: 67185.UNK.UNK.UNK.pb.heavy.1.raw 67185
ctatgcgccttgccagcccgctcagacagtatataggaagtagtccttgaccaggcagcccagggccgctgtgccccagaggtgctcttggaggagggtgccaggggaagacgatgggcccttgtgaggctgaggagacggtgaccgtggtcccttggcccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccaccactccagccccttgcctggagcctggcggacccagtgcatgccataggtactgaaggtgaatccagacgctgcacaggagagtctcaggacctcccaggctggacacgcctccccagactccaccagctgcacctgacactggacacctcttaaaagagcaacgaggaaaacccagctcagcccaaactccatggtgagtctctgtgttcagtgctgatcacgaatggaaacaccgccgacttctagtgctgggctcctctccagagctcccgcgactgagtgatactaaatcgagcacggtcgtgtatatactgtctgatggcgcgagggaggcgatacg

SEQ ID NO: 793401 - DNA, 610 bp, Homo sapiens
  misc_feature: 67193.44.36.D03.1.pb.heavy.1.raw 67193
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaaactgctcttcagagatgtactgtaggatttttccgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 793402 - DNA, 665 bp, Homo sapiens
  misc_feature: 67210.UNK.UNK.UNK.pb.heavy.1.raw 67210
ctatgcgccttgccagcccgctcagacagtatatataggaagtagtccttgaccaggcagcccagggccgctgtgcccccagaggtgctcttggaggaggtgccagggggggggaagaccgatgggccttggtggaggctgaggagacggtgaccagggtccctggcccagtggtcaaagtagttggtgacgaactgccctactctcgcacagtaatacacggccgtgtccgcggcggtcacagagctcagcttcagggagaactggttcttgacgtgtctactgatatggtgactcgactcttgagggacgggttgtgtaggaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctggacaggacccatctggagccgcaccagcaggaggaagaaccacaggtgcttcatgttcttgcacaggaggtccatgactctcagaaagccccccgcggaatctacactacaaatcgagcaccggtcgtgtatatactgtctgatggcgcgagggaggcgatacg

SEQ ID NO: 793403 - DNA, 714 bp, Homo sapiens
  misc_feature: 67211.44.33.C11.1.pb.heavy.1.raw 67211
ctatgcgccttgccagcccgctcagacagtatataggaagtagtccttgaccagggcagcccaggccgctgtgccccagaggtgctcttggaggaggtgccagggaagaccgatggcccttggtggaggctgaggagacgcgaccgtgtccttggcccaggcgtccataccattggagtagagcatgtcatatctgtatccacgagcccatctctcgcacagtagtagacagcgtgtcctcggctctcaggctattcatttccagatatagtgtgttcttcgaattgtctctggagatggtgaatcggccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggacacgcctccccagactccacagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctcccaaacccaacgagctcactctaaatcgagcaccggtcgtgtatatactgtctgatggcgcgagggaggcgatacg

SEQ ID NO: 793404 - DNA, 667 bp, Homo sapiens
  misc_feature: 67214.44.81.H04.1.pb.heavy.1.raw 67214
cgtatcgcctccctcgcgccatcagacagtatatacacgaccggtgctcgatttagtagtgtagattcgcggggctttctgagaagtcatggacctcctgtgcaagaacatgaagcacctgtggttcttcctcctgctggtggcggctcccagatgggtcctgtcccagctgcagctgcaggagtcgggcccaggactggtgaaccttcggagaccctgtccctcacctgcactgtctctggtggctccatcagcaagtagtagttactactggggctggatccgccagcccccagggaaggggctggagtggattgggagtatctattatagtgggagcacctactacaacccgtccctcaagagtcgagtcaccatatcagtagacacgtccagaaccagttctccctgaagctgagctctgtgaccgccgcgacacgccggtgattactgtgcgagagtagggcagtcgtcaccaactactttgaccactggggccagggaacccctggtcacccgtctcctcagcctccaccaaaggcccatcggtcttccccctgacaccctcctccaaagagcacctctgggccacagcgggcccctggcgcctgccggtcaaggactacttcctatatactcgtctgagcgggctggcaaggcgccatag

SEQ ID NO: 793405 - DNA, 707 bp, Homo sapiens
  misc_feature: 67222.44.56.F01.1.pb.heavy.1.raw 67222
cgtatcgcctccctcgcgccatcagacagtatatacacgaccggtgctcgatttagcagacgtctgaacacacaaaggggagctctggagaggagccccagccgtgagattcccaggagtttccacttggtgatcagcactgagcacagaccccaaccatggagtttgggctaatcttgattttccttgtagtttttttagaaggtgtccagtgcgaggggcgactggcgagtcggggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagaccgacgacacaggcgtctattactgcgccaggcgatcctgggacgtcgatgcatttgatatttgggccaggggacaatggtcaccgtctcttcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793406 - DNA, 700 bp, Homo sapiens
  misc_feature: 67249.UNK.UNK.UNK.pb.heavy.1.raw 67249
ctatgcgccttgccagcccgcccagacagtatataggaagtagtcctgccaggcagccagggccgctgtgctctcggaggtgctcctgggagcaggggcgccaggggaagaccgatgggcccttgtggaggctgaggagacggtgaccagggttccctggccccagtggacagttcctgatataaacacaacacaataatacatgcccgtgtcctcgttttcaggttagtcattcgcagaatcaatgagttcttgaagtcatctcttgagagggtgaatctggctttcacagacgcgggcgtactctgtgataaagctggcaacttgtttttacttgcggcaagccctccagcccttccctggagcctggcgggaccccagtccatatgtggtccactgatggtgaatccagaggcgacacaggagagtctcagggaccctccaggctggaccaagtctcccccggactccaccaactgcacttcactctggacaccttgtaaaaaacaacaaggaaaacccagctcagcccgaactccatggtgagttcctctgtgttcagtgctgatcaccaaatgaaaacacctggaattctggggctggggctccgctctcagagctcccaagagagatgtgacgcagctaaatcgagcaccggtcgttgtatatactgtctgatggcgcgagggaggcgatacac

SEQ ID NO: 793407 - DNA, 694 bp, Homo sapiens
  misc_feature: 67250.44.55.E11.1.pb.heavy.1.raw 67250
ctatgcgccttgccagcccgctcagacagtatataggaagtagtccttgaccaggcagccaggccgctgtgcccccagaggtgctcttggaggagggtgccagggggaagaccgatgggcccttggtggaggcggaggcgacggtgaccagggttcctggcccagaagtcaaacgaataataaccactccgagcgccgactgtgtctcgacagtaatagacggccgtgtcgtcgcctctcaggttgttcatttgagataaaccgtgttcctggaattgtccctggagatggtgaatcggcccttcacggagtctgcgtagtatgtgaaatcaccagtataaatgactgagacccactccagccccttcctggagcctggcggacccaactcatgtagttgctgctgacggtgagcccagaggctgcacaggagagtctctgggaccccccaggctggactaagcctcctccagactccatcagccgcacctcacactggacacctttaaaagtccaacaaggagaacccagctcagccaaactccatggtgagtcctctgtgttcagtgctgatcaccgaatggaaacacctcggaatccagtgctgggctctctccccccaaacccaacgtgcgagtgctaaatcgagcaccggtcgtgtatatactgtctgatggcgcgaggaggcgatacg

SEQ ID NO: 793408 - DNA, 693 bp, Homo sapiens
  misc_feature: 67265.UNK.UNK.UNK.pb.heavy.1.raw 67265
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacgcgtgaccagggttccctggccccaggggtcgaaccaatttccatgtgtgggactatgagagggactatgaagttgacgagggctctcgcacagaaatagatggccgtgtcttcagatctcagcctgctcagctccatgtaggctgtactcgtggattcgtccgcggtaatggtgactctgtcctgaaacttctgtgcgtaattcgatgcaccaaagatagggatgatccctcccagccactcaagcccttgtccaggggcctgtcgcacccaaataaaagcatagctgaagaaggtgcctccagaagccttgcaggagaccttcaccgaggacccaggcttcttcacctcagccccagactgcaccagctgcacctgggactggacacctgtagctgctgccaccacaaagaggaacccgccaggtccagtccatggtgatgagctgtgctcccaggggcttctttagaggaggagtgtggttgttatgtgatcaaaatcgagcaccgtcgtgtatatactgtctgatggcgcgagggaggcgatacg

SEQ ID NO: 793409 - DNA, 699 bp, Homo sapiens
  misc_feature: 67274.44.36.D03.1.pb.heavy.1.raw 67274
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggctggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgtttgtgtttatatcaggaactgtccactggggccagggaaccctggtcaccgtctcctcagcctccaccaagggcccatcgtcttccctggcgccctgctccaggagcacctccgagagcacagcggcctgggctgcctggtcaaggactacttcctatatactgtctgagcgggctggcaaggcgcatag

SEQ ID NO: 793410 - DNA, 687 bp, Homo sapiens
  misc_feature: 67314.UNK.UNK.UNK.pb.heavy.1.raw 67314
ctatgcgccttgccagccgctcagacagtatataggaagtagtccttgaccaggcagcccagggccgctgtgctcctcggaggtgctcctggagcgggcgccagggggaagaccgatgggccccttggtgggctgaggagcggtgaccagggttccctggccccagtgacagttcctgatataaacacaacacaataaatacatgccgtgtctcggtttttcaggttagtcattcgcagaatcaatgagttcttgaagtcatctcttgagagggtgaatctggctttcacagacgcggcgtaactctgtgataaagctggcaactttgttttactgcggccaagccactccagccccttcctggagcctggcgaccagtccatatagtggtcactgatggtgaatccagaggcgacacaggagagtctcagggaccctccaggctggaccaagtctccccgactccaccaactgcacttcactctggacaccttgtaaataacaacaaggaaaacccagctcagccgaactccatggtgagtcctctgtgttcagtgctgatcaccaaatgaaaacacctgggaattctgggctgggcttccgctctcccccaagagagatcgtgacgcagctaaatcgagcacgtcgtgtatatactgtctgatggcgcgaggaggaggcgatacg

SEQ ID NO: 793411 - DNA, 701 bp, Homo sapiens
  misc_feature: 67323.UNK.UNK.UNK.pb.heavy.1.raw 67323
ctatgcgccttgcccagcccgctcagacagtatataggaagtagtccttgaccaggcagcccagggccgctgtgcccccagaggtgctcttggaggagggtgccaggggaagaccgatgggcccttggtgaggcggaggcgacggtgaccagggttccctggcccagaagtcaaacgaataataaccactccgagcgccgacttgtctcgcacagtaatagacggccgtgtcgtcgcctctcaggttgttcatttgagataaaccgtgttcctggaattgtccctggagatggtgaatcggcccttcacggagtctgcgtagtatgtgaaatcaccagtataaatgactgagacccactccagccccttccctggagcctggcgggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgcctaaatcgagcacggtcgtgtatatactgtctgatggccgagggaggcgatacg

SEQ ID NO: 793412 - DNA, 673 bp, Homo sapiens
  misc_feature: 67342.UNK.UNK.UNK.pb.heavy.1.raw 67342
cgtatcgcctcctgcgcgccatcagacagtatatacgacgaccgtgctcgatttagcacacgatagttgggtttggggatactttctgagactcatgggcctcctgcacagaacatgaaacacctgtggttctctcctcctggtggcacctcccagatgggtcgtgtccgaggtgcagctgcagggagtcgggccaggacgggtgaagccttcggagaccctgtccctcacctgcaatgtctctggtggttacatcagtagttattattggagttggctgcggcagtccgccgggaagggactggagtggacttggcgcatctataacagtggcagcaccaaactacaaccccgcccctcaagagtcgagtcaccatgtcactagacaggtccaagaaccagttctccctgaaattgacttctgtgacgccgcggacacggccggtatatttatgtgcgagaggattcctatcgatacagtagagacggggcggcgaactggctcgaccgcctggggccaggaaccctgtcaccgtctctcagcctccccaagggccatcgtcttccccctggcaccctctccaagagcacctctgggggcacagcgccctggctgcctggtcaagggactacttcctatatactgtctgagcgggctggcaacggcgcatag

SEQ ID NO: 793413 - DNA, 756 bp, Homo sapiens
  misc_feature: 67376.UNK.UNK.UNK.pb.heavy.1.raw 67376
cgtatcgcctccctcgcgcgccatcagacagtatatacacgaccggtgctcgatttagacgcgaatcgaaagggtttggggagccctgggagacgagcccagcactcggaagtcgcggtgtttcccactcggtgatcatcactgaacacagagacttcaccatggagtttgggctgagctgggttttcctcgttgccctcttaagaggtgtcatgtgtcaggtgcaattcgtggagtctgggggaggcgtggccccagtagggggtccctgagactctcctgtgcgagctcctcgcggattcaccttcgtatagatatgtggaatatgcaggtgggtccgccaggctccaggcgagggctggacgtgggtggcaggtgtgtcatttcatggaggaaatcaaagtctacggtgcattccgttgacgggccgatttcaccatcatccagagaactaaattcgcgagaacagacagtgtctcttcaaaatgaacagcctgagacctcagacgcgacgacggccgtggccgttattttgtgcgagactatctgtttccaaaatcggttcattcgacgcctgtggccaggggaacgcctggtcaccgtctcctcggcctccacaaggcgcccatcggtctttcccccctggcgcccctgctccaggagcacctccgagaggcacagcggccctgggctgcctggtccaacggactactttcctatatactgtctgagcggggctggcaaggcgcatagatc

SEQ ID NO: 793414 - DNA, 693 bp, Homo sapiens
  misc_feature: 67382.44.74.G08.1.pb.heavy.1.raw 67382
cgtatcgcctccctcgcgccatcagacagtatatacacgaccggtgctcgatttagtagctctatcagggggagcatcacataacaaccacattcctctctaaagaagcccctgggagcacagctcatcaccatggactggacctgaggttcctctttgtggtggcagcagcaaacaggtgtccagtccctggtgcaactggtgcagtctggactagaatgccgcaaccttggtcctcggtgaccctttcctgcacggcctctggagtactaccagttccactacttataccatcaactgggtgcgccagcccctggacaagggcttgagtggatgggtggaatcaatccctctttttggctcactcacctacgcacgagacttccgggcagaattacgattaccgcggacaagtccacagacacagtctccatgacaatgagttctttgatccgacgacacggccgtctactacatgtgcgaggagtccgtaccccagctcgcatggagccttttgaatctgggggcagggaaccctggtcattgtcacctatcagcttccaccaaggggcccatcggttttccccctggcgccctgctccagaagcacctctggagggcacgcggccctgggctgcctggtcaaggactactttcctatatactgtctgagcgggctggcaaggcgcatag

SEQ ID NO: 793415 - DNA, 702 bp, Homo sapiens
  misc_feature: 67388.UNK.UNK.UNK.pb.heavy.1.raw 67388
cgtatcgcctccctcgcgcccatcagacagtatatacacgacccgtgctcgatttagcagacgtctgtcgcggggagctctgagagaggagcccagcctgggattttcaggtgttttcatttggtgatcaggactgaacagagagaactcacatggagtttgggctgagtggcttttcttgtgactattttaaaaggtggtccagtgtgaggtggccctgttggagtctggggaggattggcacagcctggggggcgtcctgagactctcctgtgcagcctctggcttccctttaggagctatgccatgacctgggtccgccaggctccagggaggggctcgagtgggtctcgacaattggcgctagtgcaactgacacatactacggagagtccgtgaaggccgcttcaccatctccagagacaattccggaacacactttttctggaatgaacagcctgagagtcgaagacacggccctttattttctgtgcgaagaggggggggactggatccgacagtgggtgggtggttcaatcctggggccagggagccctggtcaccgtcgccggcgcctccaccaagggccatcggtcttcccctggcaccctcctccaagagcacctctggggggcacagcggcctggctggcctggtcaaggactacttcctatatactgtctgagcgggctggcaagggcg

SEQ ID NO: 793416 - DNA, 703 bp, Homo sapiens
  misc_feature: 67394.44.27.C05.1.pb.heavy.1.raw 67394
gtatcgcctccctcgcgccatcagacagtatatacacgaccggtgctcgatttagacgcgatcgaagggtttggggcctggagacgagcccagcactggaagtcgccggtgtttccactccggtgatcatcactgaacacagaggactcaccatggagtttgggctgagctgggttttcctcgttgccctcttaagaggtgtcatgtgtcaggtgcaattcgtggagtctggggggaggcgtgccccagtaggggggtccctgagactctcctgtgcagcctctggattcaccttcgataattggaatatgcagtgggtccgccaggctccaggcgagggctggagtgggtggcaggtgtgtcatttcatggaggaaatccaagtctacggtgattccgttgaggccgattcaccatctccagagacaattccgagaacacagtgtctcttcaaatgaacagcctgagacctcaggacacggccgtgtatttttgtgcgagactatctgtttccaaaatccggttcattcgacgcctgggccagggaaccctggtcaccgtctcctcggcctccaccaagggccatcgtcttccccctggcgccctgctccaggagcacctccgagagcacagcggccctgggctgcctggtcaaggactacttcctatatactggtctgagcgcggctggcaaggcgcatag

SEQ ID NO: 793417 - DNA, 725 bp, Homo sapiens
  misc_feature: 67397.44.33.C11.1.pb.heavy.1.raw 67397
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaaacccaggtcagcccaaactccatggtgagtcctctgtgttcggtgctgatcaccgactggaaacaccgccgacttctggtgctgggctcctctcccagcccaaaccaacgagctcactctaaatcgagcaccggtcgtgtatatactgtctgatggcgcgagggaggcgatacg

SEQ ID NO: 793418 - DNA, 726 bp, Homo sapiens
  misc_feature: 67400.44.39.D06.1.pb.heavy.1.raw 67400
cgtatcgcctccctcgcgccatcagacagtatatacacgaccggtgctcgatttagtgacatctcgcagttcttgggggagagacgagccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagccgggaggtccctgagactctcctgtgtagcctctgggttctcattcgatagatttggtttgcactggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgaggggggaacctccaaggaaaccggttcggggaatcataaactactactatttgatggatgtctggggcagggggacgtcggtcaccgtctccttcagcttccaccaaggggccatcggtcttccccctggcgccctgctccaggagcacctctgggggcacagcggccctgggctgcctggtcaaggactacttcctatatactgtctgagcgggctggcaaggcgcat

SEQ ID NO: 793419 - DNA, 614 bp, Homo sapiens
  misc_feature: 67411.UNK.UNK.UNK.pb.heavy.1.raw 67411
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcggctacagacatttaactcgctagtaacttaattgagatcctaggggatgggataggaaatagaatccaccccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccataagccagtcacaggtaataaacaattcaacgtggcgtaaagattggccgcttgctgtgggcattgcaagctgggtttgcagcattgtgcatgctagacgacaatatgaatctgcgggaccccttagttggccaagatggccgctagcgggttccgcagctttttgacctggaccagggtgcatagcctgcccagccttc

SEQ ID NO: 793420 - DNA, 707 bp, Homo sapiens
  misc_feature: 67412.44.27.C05.1.pb.heavy.1.raw 67412
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctcccaaacccttcgatcgcgtctaaatcgagcaccggtcgtgtatatactgtctgatggcgcgagggaggcgatacg

SEQ ID NO: 793421 - DNA, 728 bp, Homo sapiens
  misc_feature: 67414.44.33.C11.1.pb.heavy.1.raw 67414
cgtatcgcctcctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactgggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggcctcgtggatacagatatgacatgctctactccaatggtatggacgcctggggccaagggaccacggtcgccgtctcctcagcctccaccagggcccatcggtcttcccctggcacccctcctccaagagcacctctggggcacagcggccctgggctgcctggtcaaggactacttcctatatactgtctgagcgggctggcaggcgcatag

SEQ ID NO: 793422 - DNA, 674 bp, Homo sapiens
  misc_feature: 67418.44.27.C05.1.pb.heavy.1.raw 67418
tatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 793423 - DNA, 542 bp, Homo sapiens
  misc_feature: 67427.44.38.D05.1.pb.heavy.1.raw 67427
cgtatcgcctccctcgcgccatcagacagtatatacacgaccggtgctcgatttagtatctgatagttcagcctgggggtcctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgagacacggctgtgtattactgtgcaagagccggtgcgggagttcggggagttgcatactactactacggtatggacgtctggggccaagggaccacggtcaccgtctcctccagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793424 - DNA, 697 bp, Homo sapiens
  misc_feature: 67430.UNK.UNK.UNK.pb.heavy.1.raw 67430
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacggtgaccagggttccctggccccaggcgtcgaatgaaccgattttgaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactcagcccctcgcctggagcctggcggacccactgcatattcaattatcgaaggtgaatccagaggctgcacaggagagtctcagggacccccctactgggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttcagtgctgggctcgtctcccagccccaaacccttcgatcgcgtctaaatcgagcaccgtcgtgtatatactgtctgatggcgcgagggaggcgatacg

SEQ ID NO: 793425 - DNA, 703 bp, Homo sapiens
  misc_feature: 67436.44.55.E11.1.pb.heavy.1.raw 67436
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacacctttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 793426 - DNA, 712 bp, Homo sapiens
  misc_feature: 67441.44.67.G01.1.pb.heavy.1.raw 67441
cgtatcgcctccctcgcgccatcagacagtatatacacgaccggtgctcgatttagagtatacatattgggtttggggggagaggagcccagcactgggattccgaggtgtttccattcggtgatcagcactgaacacagaggactcaccatggagttttggctgagctgggttttcccttgttggacttttaaaaggtgtccagtgtgaggtgcggctgatggagtctggaggaggcttagtccagcctggggggtcccagagactctcctgtgcagcctctgggctcaccgtcagcagcaaactacatgagttgggtccgccaggctccagggaaggggctggagtgggtctcagtcatttatactggtgatttcacatactacgcagactccgtgaagggccgattcaccatctccagggacaattccaggaacacggtttattcttcaaatgaaacaacctgagaggcgacgacacggccgtctattactgtgcgagacaagtcggcgctcggagtggttattattcgtttgacttctggggccagggaaaccctggtcaccgtcgcctccgcctccaccaagggcccattcggtctttccccctggcaccctcctccaagagcacctctgggggcacagcggccctgggctgcctggtcaaggactacttcctatatactgtctgagcgggctggcaaggcgcatag

SEQ ID NO: 793427 - DNA, 709 bp, Homo sapiens
  misc_feature: 67458.44.36.D03.1.pb.heavy.1.raw 67458
cgtatcgcctccctcgcgccatcagacagtatatacacgaccggtgctcgatttagctgcgtcacgatctctcttggggagctctgagagcggagccccaggccccagaattcccaggtgttttcatttggtgatcagcactgaacacagaggactcaccatggagttcgggctgagctgggttttccttgttgttattttacaaggtgtccagagtgaagtgcagttggtggagtccgggggagaactttggtccagcctggagggtccctgagactctcctgtgtcgcctctggattcaccatcagtgaccactatatggactggtccgccaggctccagggaaggggctggagtggcttggccgcagtaaaaacaaagttgccagctttatcacagagtacgccgcgtctgtgaaagccagattcaccctctcaagagatgacttcaagaactcattgattctggcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagaggcacagcggccctgggctgcctggtcaaggactacttcctatatactgtctgagcgggctggcaaggcgcatag

SEQ ID NO: 793428 - DNA, 570 bp, Homo sapiens
  misc_feature: 67465.UNK.UNK.UNK.pb.heavy.1.raw 67465
ccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgacgtcccctgccccagacatccatcaaatagtagtagtttatgattcccccgaaccgtttccttggaggtccccctcgcacagtaataaaacagacgtggtccgtcaactctcacgctgttcattttgcaaatacagcatattcttggaattgtctctggagatggtgaatcggcccttcacggagtctgagtaatacttctcacttccatcgtcggagatgactgccacccactccggccccttgcctggagcctggcggacccagtgcaaaccaaatctatcgaatgagaacccagaggctacaccaggagagtctcagggacctcccgggctggaccacgcctcccccaaacccaacacactctctctaaaatcgagcaccggtgtgtatatactgtctgatggcgcgagggaggcgatacg

SEQ ID NO: 793429 - DNA, 701 bp, Homo sapiens
  misc_feature: 67536.44.27.C05.1.pb.heavy.1.raw 67536
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctggttttcctcgttgccctcttaagaggtgtcatgtgtcaggtgcaattcgtggagtctgggggaggcgtggcccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793430 - DNA, 707 bp, Homo sapiens
  misc_feature: 67537.44.36.D03.1.pb.heavy.1.raw 67537
ctatgcgccttgccagcgccgctcagacagtatataggaagtagtccttgaccaggcagcccagggcggctgtgctctcgaggtgctcctggagcagggcgccaggggaagaccgatgggcccttggtggaggctgaggagacggtgacccagggttccctgcccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttcctggagcctggcggacccagtccatatagtggtcactgatggtgaatccaggggcgacacaggagagttctatctcagggaccctccaggctggaccaagtctcccccggactccaccaactgcacttcacctctgggacaccttgtaaaataacaacagaaaacccagctcagcccgaactccatggtgagtcctctgtgttcagtgctgatcaccaaatgaaaacactgggaattctgggctgggctccgctctcagagctccccaagagagatcgtgacgcagctaaatcgagcaccggtcgtgtatatactgttctgatggcgcgagggaggcgatacg

SEQ ID NO: 793431 - DNA, 596 bp, Homo sapiens
  misc_feature: 67544.UNK.UNK.UNK.pb.heavy.1.raw 67544
gaaggctgggcaggctatgcaccctggtccaggtcaaaagctgcggaacccgctagcggccatcttggccactaggggtccgcagattcatattgtcgtctagcatgcacaatgctgcaaacccagcttgcaatgcccacagcaagcggccatctttacgccacgttgaattgtttattacctgtgactggctatggcttgcaacgccactcgtaaaactagtactttgcgttaggggaagtagacaaaccattactcacttcccggaagttcaactcattccaacacgaaataaagtaaactcaacacccaagcaggctatgtggggggtgatagggtggattctatttcctatcccatcccctaggatctcaattaagttactagcgagttaaatgtctgtagcgatcccgtcagtcctatcgcgcgcatcaagacctggttggttgagcgtgcagtagatcatcgatagctgcgagttaggtcatcccagaccgcatctggcgcctaacgttcagtggtagctaaggcgtcaccttcgactgtctaaaggcaatatgtcgtccttagctccaagtccctagcaagcgtgtcgg

SEQ ID NO: 793432 - DNA, 705 bp, Homo sapiens
  misc_feature: 67551.44.62.F07.1.pb.heavy.1.raw 67551
cgtatcgcctcctcgcgccatcagacagtatatacacgaccggtgctcgatttagtagtcgcataaagggaaaggggagctctgagagaggagcccagccctgggatttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcggcctgggaggtccctgaccctctcctgtgcggcctctggattcacctttagtgcctatggcatgacctgggtccgccgggctccaggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccggggacagtggtgaccgtctcttcagcctccaccaagggccatcggtcttcccctggcgccctgctccaggagcacctccgagagcacagcggccctgggctgcctggtcaaggactacttcctatatactgtctgagcgggctggcaaggcgcatag

SEQ ID NO: 793433 - DNA, 717 bp, Homo sapiens
  misc_feature: 67582.UNK.UNK.UNK.pb.heavy.1.raw 67582
cgtatcgcctccctcgcgccatcagacagtatatacacgaccggtgctccgatttagcagacgtctgtcgcggggagctctgagagaggagcccagccctgggattttcaggtgttttcatttggtgatcaggactgacagagagaactcaccatggagtttgggctgaggtggctttttcttgtgactattttaaaaggtgtccagtgtgaggtggccctgttggagtctggggggaggattggcacaggcctggggggtccctgagactctcctgtgcagcctctggcttcccctttaggagctatgccatgacctggtccgccaggctccagggaaggggctcgagtgggtctcgacaattgggctagtgcaactgaccatactacgagagtccgtgaaggggccttcaccattcccagagacaattccggaaacacaatttttctggaatgaacagcctgagagtcgaagacacggcccctttatttctgtgcgaagaggggggggactggatcccacagtgggtgggtggttcaaactcctggggccagggaagccctggtcaccgtcgccgcagcctccaccaagggcccatcggtcttccccctggcaccctcctccaaagagcacctctgggggcacagcgcccctgggctgcctggtcaaggaaactacttcctatatactgtctgagcgggctggcaaggcgcatag

SEQ ID NO: 793434 - DNA, 708 bp, Homo sapiens
  misc_feature: 67589.44.27.C05.1.pb.heavy.1.raw 67589
cgtatcgcctccctcgcgccatcagacagtatatacacgaccggtgctcgatttagacgcgatcgaagggtttggggctgggagacgagccagcactggaagtcgccggtgtttccactcggtgatcatcactgaacacagaggactcaccatggagtttgggctgagctgggttttcctcgttgccctcttaagagtgtcatgtgtcaggtgcaattcgtggagtctgggggaggcgtggccccagtaggggggtccctgagactctccttgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgcgagaacacagtgtctcttcaaaatgaacagcctgagacctcaggacacgggccgtgtatttttgtgcgagactatctgtttccaaaatcggttcattcgacgcctggggccagggaaccctggtcaccgtctcctcggcctccaccaaggcgccatcggtcttccccctggcgccctgctcaggagcacctccgagagcacagcggccctgggctgcctggtcaaggactacttcctatatactgtctgagcggggctggccaaggcgcatag

SEQ ID NO: 793435 - DNA, 704 bp, Homo sapiens
  misc_feature: 67594.44.62.F07.1.pb.heavy.1.raw 67594
ctatgcgccttgccagcccgctcagacagtatataggaagtagtccttgaccaggcagcccagggccgctgtgctctcggaggtgctcctggagcagggcgccaggggaagaccgatgggcccttggtggaggctgaagagacggtcaccactgtcccccggccccaagtactaaaggtgtcatggggggtcaccgtggtcctggctttcaaacagtaatagacgcctgtgtcctcggtctcaggtttttcatttggagaaacaatttgtcctgcgaattgtccctggaaatggtgaagcggcccttcacggagtctccgtagaagtgacaccaccagctccgatacttgagacccactccagtcccctccctggagcccggcggacccaggtcatgccataggcactaaaggtgaatccagaggccgcacaggagagggtcagggacctccaggccgaatcaggcccccccagactccaacaactgcacttcacacacgacacctttaaaaaagccacaagaaaaaggcagctcagcccaaactccatggagacttctctctgttcggtcctggtcaccaaatgaagacacctgaaaatcccagggctggctcctctctcagagctccctttccctttatgcgactactaaatcgagcaccggtcgtgtatatactgtctgatggcgcgagggaggcgatacg

SEQ ID NO: 793436 - DNA, 572 bp, Homo sapiens
  misc_feature: 67620.UNK.UNK.UNK.pb.heavy.1.raw 67620
gaagctgggcactatgcacctggtccaggtcaaagctgcggaacgctagcgccatcttggccactagggtccgcagattcatattgtcgtctacatgcacaatgctgcaaaccagcttgccaatgcccacagcaagcggccaatcttacgcacttgaattgttattactgtgactggctatggcttgcaacgcactcgtaaaactagtactttgcggttaggaagtagacaaaccattactccacttccggaagttcaactcattccaacacgaaataaaagtaaatccaacaccccaagcaggctatgtgggggtgataggtggattctatttcctatccatccctaggatctcaattaagttactagcgagttaaatgtctgtagcgatccgtcagtcctatcgcgcgcatcaagacctggttggttgagcgtgcagtagatcatcgataagctgcgagttagtcatccagacgcatctggcgcctaaacgttcagtgtagctaggcgtcaccttcgactgtctaaaggcaatatgtcgtccttagtccaagtcctagcaagcgtgtcgg

SEQ ID NO: 793437 - DNA, 677 bp, Homo sapiens
  misc_feature: 67628.44.35.D02.1.pb.heavy.1.raw 67628
ctatgcgccttgccagcccgccagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcgggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgagcaccggtcgtgtatatactgtctgatggcgcgagggaggcgatacg

SEQ ID NO: 793438 - DNA, 690 bp, Homo sapiens
  misc_feature: 67631.44.55.E11.1.pb.heavy.1.raw 67631
cgtatcgcctcctcgcgccatcagacagtatatacacgaccggtgctcgatttagcactcgcacgttggtttggggggcgagagcccagcactgggattccgaggtgtttccattcggtgatcagcactgaacacagaggactcaccatggagttttggctgagctgggttctccttgttggacttttaaaaggtgtcagtgtgaggtgcggctgatggagtctggaggaggcttagtccagcctggggggtccagagactctcctgtgcagcctctggctcaccgtcagcagcaactacatgagttgggtccgccaggctccagggaagggctggagtgggtctcagtcatttatactgtgatttcacatactacgcagactccgtgaagggccgattcaccatctccagggacaattccaggaacacgtttatcttcaaatgaacaacctgagaggcgacgacacggcgtctattactgtgcgagacaagtcggcgctcgagtggttattattcgtttgacttctggccagggaaccctggtcaccgtcgcctccgcctccaccaagggcccatcggtcttccccctggcaccctcctccagagcacctctgggggcacagcggccctgggctgcctggtcaaggactacttcctatatactgtctgagcgggctggcaagcgcatag

SEQ ID NO: 793439 - DNA, 703 bp, Homo sapiens
  misc_feature: 67633.44.73.G07.1.pb.heavy.1.raw 67633
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctcccccagactccaccaggtgcacctgacactggacacctcttaaaagagtaacgaggaaaacccagctcagcccaaactccatggtgagtcctctgtgttcagtgctgatcaccgaatggaaacaccgtcgacttctagtgctgggctcctctccagagctcccctgagcgtagagctaaatcgagcaccggtcgtgtatatactgtctgatggcgcgagggaggcgatacg

SEQ ID NO: 793440 - DNA, 703 bp, Homo sapiens
  misc_feature: 67679.44.55.E11.1.pb.heavy.1.raw 67679
ctatgcgccttgccagcccgctcagacagtatataggaagtagtccttgaccaggcagcccagggccgctgtgcccccagaggtgttcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgaggaggcgatacg

SEQ ID NO: 793441 - DNA, 660 bp, Homo sapiens
  misc_feature: 67693.44.12.B01.1.pb.heavy.1.raw 67693
cgtatcgcctccctcgcgccatcagacagtatatacacgaccggtgctcgatttagtagtgtagattccgcggggctttctgagagtcatggaccttcctgtgcaagaacatgaagcacctgtggttcttctctgctgtgtcggctcccgatgggtcctgtcccagctgcagctgcaggagtcgggcccaggactggtgaagccttcggagaccctgtccctcacctgcactgtctctggtggctccatccagcagtagtagttacactgggctggatccgccagccccccagggaagggctggagtggattggagtatctattatagtgggagcacctactacaacccgttccctcaagagtcgagtcaccatatcagtagacacgtccaagaaccagttctcctgaagctgagctctgtgaccgccgcggacacggccgtgtattactgtgcgagagtagggcagttcgtcaccaactactttgaccactggggccagggaaaccctggtcaccgtctcctcagccctccaccaaggccatcggtcttcccccctggcacctcctccaagagcacctctggggcacagcggcgccctgggctgcctggtcaaggactacttcctatatactgtctgagcgggctggcaaggcgcatag

SEQ ID NO: 793442 - DNA, 690 bp, Homo sapiens
  misc_feature: 67695.44.53.E09.1.pb.heavy.1.raw 67695
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagcccccttccctggagcctggcggacccagggtcatccaggcgttactgaaagtgaatccagaggctgcacaggagagtctaagggactcccccaggcttttaccaaacctcccccagactccaccaactgcacctcacactggacaccttttaaaatagcagcaaggaaaatccagctcagcccaaaactccatggtgagtcctctgtgttcagtcctgatcactgaatgaaaacacacctgggaatcccaagggctggggctcctctcccagagctcaacacactctctctaaatcgagcaccggtcgtgtatatactgtctgatggcgcgagggaggcgatacg

SEQ ID NO: 793443 - DNA, 731 bp, Homo sapiens
  misc_feature: 67718.44.86.H09.1.pb.heavy.1.raw 67718
ctatgcgccttgccagcccgctcagacagtatataggaagtagtccttgaccaggccagcccagggccgctgtgccccccagaggtgctcttggaggagggtgccagggggaagaccgatgggcccttggtggaggctgaggagacggcgaccgtggtcccttggcccaggcgtccataccattgagtagaggcatgtcatatctgtatccacggccccatctctcgcacagtagtagacagccgtgtcctcggctctcaggctatcatttccagatatagtgtgtttcttcgaattgtctctggagatgggaatcggcccttcacggaatctacataaatatttattacttccatcataccatattaagtgccacccactccagtcccttgcctggagccctggcggacccagtgcatgccatgtctgttgaagtgaatccagacgctacaacaggagagtctcagggacgcctccaggctggaccacgcctcccccagactccaccagcttcacctgacactggacacctcttaaaagagcaacgaggaaaaccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 793444 - DNA, 705 bp, Homo sapiens
  misc_feature: 67729.UNK.UNK.UNK.pb.heavy.1.raw 67729
ctatgcgccttgccagcccgctcagacagtatataggaagtagtccttgaccaggcagcccagggccgctgtgcccccagagtgctcttggagagggtgccagggggaagaccgatgggcccttggtggaggcggaggcgacggtgaccagggttccctggccccagaagtcaaacgaataataaccactccgagcgccgacttgtctcgcacagtaatagacggggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccaacccaacgtgcgagtgctaaatcgagcaccgggttcgtgtatatactgtctgatggcgcgaggaggcgatacg

SEQ ID NO: 793445 - DNA, 618 bp, Homo sapiens
  misc_feature: 67733.UNK.UNK.UNK.pb.heavy.1.raw 67733
aaggctggggcaaggctatgccacccctggttccaggtcaaaagctgcggaacccgctagcggaccatcttggccactaggggtcccgcagattcatattgtcgtctagcatgcacaatgctgcaaacccagcttgcaatgccccacagcaagcggccaatctttacgccacgttgaatctgtttaattacctgtgactggctatggcttgcaacgccaactcgtaaaactagtactttgcggttagggggaagtagacaaacccattactccacttcccggaagttcaactcattccaacacgaaataaaagtaaactcaacaccccaagcaggctatgtgggggggtgataggggtggattctatttcctatccccatcccctaggatctcaattaagttactagcgagttaaatgtctgtagcgatcccgtcagtcctatcgcgcgcatcaagacctggttggtgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 793446 - DNA, 656 bp, Homo sapiens
  misc_feature: 67738.UNK.UNK.UNK.pb.heavy.1.raw 67738
ctatgcgccttgccagcccgctcagacagtatataggaagtagtccttgaccaggcagcccagggccgctgtgctctcggaggtgctcctggagcagggcgccaggggaagagccgatggccccttggtggaggctgaggatgaggagaccggtgaccgtggtcccttggccccagacgtccaagcgtagtagaattgagacgacctgccataggcggacccatgtctgacacagtagtagacagccgtgtcggcggcggcacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaaattacttctgtcgatggaggccaccagagaccgtgcacgtgagggacagggtctccgaaggcttcacagtcctgggccgactcccgcagctgcgcctgagacaggacccatctgggagccgccaccagcagggaggaagaaccacaggtgcttcccccaaacccaacacactctctctaatcggagcaccggtcgtgtatatactgtctgatggcgcgaggggaggcgatacg

SEQ ID NO: 793447 - DNA, 706 bp, Homo sapiens
  misc_feature: 67753.44.36.D03.1.pb.heavy.1.raw 67753
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagctgggttttccttgttgttattttacaaggtgtccagagtgaagtgcagttggtggagtccggggagacttggtccagcctggagggtccctgagactctcctgtgtcgcctctggattcaccatcagtgaccactttatatggactgggtccgccaggctccaggaaggggctggagtggctttggccgcagtaaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcggccctgctccaggagcacctccgagagcacagcggccctgggctgcctggtcaaggactacttcctatatactgtctgagcgggctggcaaaggcgcatag

SEQ ID NO: 793448 - DNA, 640 bp, Homo sapiens
  misc_feature: 67807.44.23.C01.1.pb.heavy.1.raw 67807
ctatgcgccttgccagcccgctcagacagtatataggaagtagtccttgaccaggcagccaggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcaccggaggtcagtttcagggagaagcggttcatggacgtgtccctcgaaatggtgagacgactcttgagggacggagagtagtacgtcgcccagttaatggatgtcaccaatccactccattccctccctggggctgccgatccagcccaagaatgatcagaactgatggaaactccagagacagtgcagatgagagacagggttcccgaaggcctcaccagtcctgggcccgactctgcagctgcacctgggacaggacccatctgggagctgccaccagcaggaggaaaaccacaggtgcttcatgttcttgcacaggaggtccttgactctcagaaagccccaatccctaatcacgtgtactaaatcgagcaccggtcgtgtatatactgtctgatggcgcgaggaggcgatacg

SEQ ID NO: 793449 - DNA, 698 bp, Homo sapiens
  misc_feature: 67834.44.56.F01.1.pb.heavy.1.raw 67834
ctatgcgccttgccagcccgctcagacagtatataggaagtagtccttgaccaggcagcccagggccgctgtgccccagagtgctcctggagcagggcgccaggggaagaccgatgggccttgtggaagctgaagagacggtgaccattgtcccctggccccaaatatcaaatgcatcgacgtcccaggatcgcctggcgcagtatagacgcctgtgtcgtcggtctcaggttgctcatttgtaaatggccaacactgttggagtcatccttgagacggtgaatcttcccttcacagacgcggcgtactctttacttccaccataacgtttcattctgacgaaagtgatccactcaagccccttccctggagcctgacggacccaggcaagtgataatcactaagactgaatcctgagactacacaggagagtctcagagaccgcctggctgtgccaagcccccccgactcgccagtcgcccctcgcactggacaccttctaaaaaaactacaaggaaatcaagattagccaaactccatggttggtggtctgtgctcagtgctgatcaccaagtggaaactcctggaatctcacggctggggctcctctccagagctcccctttgtgtgttcagacgtctgctaaatcgagcaccggtcgtgtatatactgtctgatggcgcgagggaggcgatacg

SEQ ID NO: 793450 - DNA, 656 bp, Homo sapiens
  misc_feature: 67847.UNK.UNK.UNK.pb.heavy.1.raw 67847
cgtatcgcctccctcgcgccatcagacagtatatacacgaccggtgctcgatttgagaggagagtgtgttgggtttgggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggaacacctactacaacccgtccctcaacggtcgagtcaccatatccgtggacacgtcgaggacacagttttccctgaagtgagttctgtggccgccgccgacacggctgtctactactgtgtcagacatggggtccgcctatggcaggtcgtctcaattctactacgcttgggacgtctggggccaagggaccacggtcaccgtctcctcatcctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 793451 - DNA, 703 bp, Homo sapiens
  misc_feature: 67869.44.27.C05.1.pb.heavy.1.raw 67869
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793452 - DNA, 695 bp, Homo sapiens
  misc_feature: 67875.UNK.UNK.UNK.pb.heavy.1.raw 67875
cgtatcgcctcctcgcgccatcagacagtatatacacgaccgtgctcgatttagcactcgcacgttgggtttggggagaggagccagcactgggattccgaggtgtttccattcggtgatcagcactgaacacagaggactcaccatggaggttttggctgagctgggttctccttgttggacttttaaaaggtgtccagtgtgaggtgcggctgatggagtcggaggaggcttagtccagcctggggggtcccagagactctcctgtgcagcctctgggctcaccgtcagcagcaactacatgagttgggtccgccaggctccagggaaggggctggagtggtctcagtcatttatactggtgatttcacatactacccagactccgtgaagggccgattcaccatctccagggacaattccaggaacacggtttatcttcaaatgaacaacctgagaggcgacgacacggcgtctatactgtgcgagacaagtcggcgctcggagtggttattattcgtttgacttctgggccagggaaaccctggtcaccgtcgcctccgcctccaccaagggcccatcggtcttcccctggcaccctcctcaagagcacccttctggggcacagcggcctgggctgcctggtcaaggataacttcctatatactgtctgagcgggctggcaaggcgcatag

SEQ ID NO: 793453 - DNA, 726 bp, Homo sapiens
  misc_feature: 67886.44.86.H09.1.pb.heavy.1.raw 67886
cgtatcgcctccctcgcgccatcagacagtatatacacgaccggtgctcgattagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793454 - DNA, 716 bp, Homo sapiens
  misc_feature: 67890.UNK.UNK.UNK.pb.heavy.1.raw 67890
cgtatcgcctccctcgcgccatcagacagtatattacacgaccggtgctcgatttagcactcggcacgttgggtttggggagaggagcccagcactggggattccgaggtgtttccattcggtgatcagcactgaacacagaggactcaccatggagtttggctgagctggttctccttgttggacttttaaaaggtgtccagtgtgaggtgccggctgatggagtctggaggaggcttagtccagccctgggggtcccagagactcctcctgtgcagcctctgggctcaccgtcagcaggcaactacatgagttgggtccgcgccaggctccagggaaggggctggagtgggtctcagtcatttatactggtgatttcaccatactacgcagactccgtgaagggccgattcaccatctccagggacaattccaggaacacggtttatcttcaaatgaacaacctgagagggcgacgacacggccgtctattactgtgcgagacaagtcggcgctcggagtggttattatcgtttgacttctggggccagggaaccctgtcaccgtcgcctccgcctccaccaaggggcccatcggtcttcccctggcacccctcctccaagagcacctctgggcggccacagcggccctgggcctgcctggtcaaggagctacttccatatactggtctgagcgggctggcaaggggcgcatag

SEQ ID NO: 793455 - DNA, 600 bp, Homo sapiens
  misc_feature: 67910.UNK.UNK.UNK.pb.heavy.1.raw 67910
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtctgatgcgcgcgatagactgacgggatcgctacagacatttaactcgctagtaacttaattgagatcctaggggatgggataggaatagaatccacccctatcaccccccacatagcctgcttggggtgttgagttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtgcgtaaagattggccgcttgctgtgggcattgcagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793456 - DNA, 696 bp, Homo sapiens
  misc_feature: 67922.UNK.UNK.UNK.pb.heavy.1.raw 67922
agcccgctcagacagttatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaacgaataataaccactccgagcgccgacttgtctcgcacagtaatagacggccgtgtcgtcgcctctcaggttgttcatttgaagataaaaccgtgttcctggaattgtccctggagatggtgaatcggccccttcacggagtctgcgtagtatgtgaaatcaccagtataaatgactgagacccactccagccccttccctggagcctggcggacccaactcatgtagttgctgctgacggtgagccagaggctgcacaggagaagttctctgggacccccaggctggactaagcctcctccagactccatcagccgcacctcacactggacaccttttaaaagtccaacaaggagaaccagctcagcaaaactccatggtgagtcctctgtgttcagtgctgatcaccgaatggaaacacctcggaatcccagtggctggcgctcctctccccccccaaacccaacgtgcgagtgctaaatcgagcaccgcgtcgtgtatatactgtctgatggcgcgagggagggcgatacg

SEQ ID NO: 793457 - DNA, 702 bp, Homo sapiens
  misc_feature: 67927.44.36.D03.1.pb.heavy.1.raw 67927
ctatgcgccttgccagccccgctcagacagtatataggaagtagtccttgaccaggcagcccagggccgctgtgctctcggaggtgctcctggagcagggcgccaggggaagaccgatgggcccttggtggaggctgaggagacggtgacagggttccctggccccagtggacagttcctgatataaacacaacacaataatacatgccgtgtcctcggttttcaggttagtcattcgcagaatcaatgagttcttgaagtcatctcttggaagggtgaatctggctttcacagaccgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaacacctgggaattctgggctggggctccgctctcagagctccccaagagagatcgtgacgcagctaaatcgagcaccggtcgtgtatatactgtctgatggcgcgagggaggcgatacg

SEQ ID NO: 793458 - DNA, 678 bp, Homo sapiens
  misc_feature: 67932.44.74.G08.1.pb.heavy.1.raw 67932
cgtatcgcctccctcgcgccatcagacagtatatacacgaccggtgctcgatttagtagctctatcaggggagcatcacataacaaccacattcctcctctaaagaagcccctgggagcacagctcatcaccatggactggacctggaggttcctctttgtggtgcagcagcaacaggtgtccagtcctggtgcaactggtgcagtctgggactagaatgccgcaaccttggtcctcggtgacctttcctgcacggctctggaagtactaccagttccactacttataccatcaactgggtgcgccaggccctggacaaggcttgagtggatgggtggaatcatcctcttttggctcactcacctacgcacgagacttccggggcagaattacgattaccgcgacaagtccacagacacagtctccatgacaatgagttctttgaaatccgacgacacggccgtctactactgtgcgagaggtccgtaccccagctcgcatggagccttgagatctgggggcagggaaccctggtcattgtcacctcagcttccaccaagggccatcggtcttcccctggcgccctgctccaggagcacctctggggcacagcggcctgggctgcctggtcaagactacttcctatatactgtctgagcgggctggcaaggcgcatag

SEQ ID NO: 793459 - DNA, 679 bp, Homo sapiens
  misc_feature: 67945.44.45.E01.1.pb.heavy.1.raw 67945
cgtatcgcctccctcgcgccatcagacagtatatacacgaccggtgctcgatttagtgagtcagtaagggaaaggggctgggagaggagcccagcactagagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgtgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccaggagccctgtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793460 - DNA, 698 bp, Homo sapiens
  misc_feature: 67946.44.55.E11.1.pb.heavy.1.raw 67946
cgtatcgcctccctcgcgccatcagacagtatatacacgaccggtgctcgatttagcactcgcacgtgggtttgggggggagaggagcccagcactgggattccgaggtgtttccattcggtgatcagcactgaacacagaggactcaccatggagtttggctgagctgggttctcctgttggacttttaaaaggtgtccagtgtgaggtgcggctgatggagtctggaggaggcttagtccagcctggggggtcccagagactctcctgtgcagcctctgggctcaccgtcagcagcaacacatgagttgggtccgccaggctccagggaaggggctggagtgggtctcagtcattatactggtgatttcacatactacgcagactccgtgagggccgattcaccatctccagggacaattccaggaacacggtttatcttcaaatgacaacctgagaggcgacgacaacggccgtctattactgtgcgagacaagtcggcgctcggagtggttattattcgttgacttctggggccagggaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793461 - DNA, 666 bp, Homo sapiens
  misc_feature: 67959.44.86.H09.1.pb.heavy.1.raw 67959
cgtatcgcctcccctcgcgccatcagaccagtatatacacgaccggtgctcgatttagtgctatagacttgggttttgggggatgctttctgagagtccaaggaccccctcctgtgcaagaacatgaagcactgtgtttttcctcctgctgggtggcagctcccagatgggtcctgtcccaggtgcagctgcaggagtcgggcccaggactggtgaggccttcgggaaccctgtctctcatctgcactgtctctctggagtttccatcagttctgatcattcttggggctggatccggcagcccccagggaggggaatggagtggattggtgacatccattatactggggcgacgtactactctccgtccctcaagagtcgtctcaccatttcgagggcacacgtccatgaaccgcttctccctgaaactgacctccgtgaccgccgcggacacggcgtttatttctgtgcgaggcgagactggtctttcaatctatggggccgtggcaccctggtcactgtctcctcagcttccaccaagggcccatcggtcttccccctggcgccctgctccaggagcacctctggggggcacagcggccctgggctggcctggtcaaggactacttcctatatactgtctgagcgggctggcaaggcgcatag

SEQ ID NO: 793462 - DNA, 608 bp, Homo sapiens
  misc_feature: 67975.UNK.UNK.UNK.pb.heavy.1.raw 67975
cacgcttgctagggacttggaggctaaggacgacatattgcctttagacagtcgaaggtgacgccttagctaccactgaacgtttaggcgccacgatgcggtctgggatgacctaactcgccagcttatcgatgatctacctgcacgctcaaccaaccaggtcttgatgcgcgcgataggactgacgggatcgctacagacatttaactcgctagtaacttaattgagatcctagggatgggatagggaaatagaatccacccctatcaccccccacatagctgcttgggggtgttgagtttacttttatttcgtgttggaatgagttgaacttccggagtgggcgagtaatggtttgtctacttcccctaaccgcaaagtactagtttacgagtggcgttgcaagccatagccaggtcacaggtaataaacaattcaacgtggcgtaaagattggccgcttgctgtgggcattgcaagctggtttggcagcattgtgcatgctagacgacaatatgaatctgcgggaccccctagtggccaagatggccgctagcgggtttccgcagcttttgacctggaccagggtgcatagcttgcccagccttc

SEQ ID NO: 793463 - DNA, 711 bp, Homo sapiens
  misc_feature: 67979.44.36.D03.1.pb.heavy.1.raw 67979
cgtatcgcctccctcgcgccatcagacagtatatacacgaccggtgctcgatttagctgcgtcacgatctctcttggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctgggggaggcttggtacagcgggggggggtccctgagactctcctgtgcagcctctggattcatcttcagtgactatgccatgaactgggtccgccaggctccagggaaggggctggagtgggtttcatatgttaatattgctggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactggggccgggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793464 - DNA, 672 bp, Homo sapiens
  misc_feature: 67980.UNK.UNK.UNK.pb.heavy.1.raw 67980
ccttgccaggcccgctcagacagtatataggaaagtagtccttgaccaggcagcccagggccgctgtgcccccagaggtgctcttggaggagggtgccagggggaagaccgatgggcccttggtggaggctgaggagacggtgaccaggcggttccctggccccagtggtcaaagtagttggtgacgaactgccctactctcgcacagtaatacacggccgtggtccgccggccggtcacagagctcagcttcagggagaactggttcttggacgtgtctactgatatggtgactcgacttcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggccttcaccagtcctgggcccgactcctgcagctgcagctggggacaggacccatctgggagccgccaccagcaggaggaagaaccacaggtggccttcatgttcttgcacaggaggttccatgactctcagaaagccccccgcggaatctacactactaaatcgagcaccgtcgtgtatatactgtctgatggcggcgagggaggcgatacg

SEQ ID NO: 793465 - DNA, 656 bp, Homo sapiens
  misc_feature: 67993.UNK.UNK.UNK.pb.heavy.1.raw 67993
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaaagccccccaatccctaatcacgtgtactaaatcgagcaccgggtcgtgtatatactgtcttgatggcgcgagggaggcgatacg

SEQ ID NO: 793466 - DNA, 683 bp, Homo sapiens
  misc_feature: 68002.44.53.E09.1.pb.heavy.1.raw 68002
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgcctattttaaaaggtgtccagtgtgaggtgcagttggtggagtctgggggaggtttggtaaagcctggggagtcccttagactctctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793467 - DNA, 705 bp, Homo sapiens
  misc_feature: 68008.44.36.D03.1.pb.heavy.1.raw 68008
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacaccaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793468 - DNA, 592 bp, Homo sapiens
  misc_feature: 68009.44.78.H01.1.pb.heavy.1.raw 68009
cgtatcgcctccctcgcgccatcagacagtatatacacgaccggtgctcgatttagtgtgagtagttttggtttggggggaagaggaagactgacggtccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggaactacttcctatatactgtctgagcgggctggcaaggcgcatag

SEQ ID NO: 793469 - DNA, 714 bp, Homo sapiens
  misc_feature: 68014.44.85.H08.1.pb.heavy.1.raw 68014
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtactatggcatgcactgggtccgccaggctccagcaaggggctggagtggtggcacttatatggtatgatggaagtaataaatactatgcagactccgtgaagggccgattcaccatctccagagacaattccaagaacacgctgtatctgcaaatgacagcctgagagccgaggacacggctgtgtattactgtgcgagacatattgtagtactaccacctgctggactactactacggtatggacgtctggccaaggaccacggtcaccgtctcctcagcctccaccaagggcccatcgtcttccccctggcaccctcctccaagagcacctctggggggcacagcggccctgggctgcctggtcaaggactacttcctatatactgtctgagcgggctggcaaggcgcatag

SEQ ID NO: 793470 - DNA, 714 bp, Homo sapiens
  misc_feature: 68015.UNK.UNK.UNK.pb.heavy.1.raw 68015
cgtatcgcctccctcgcggccatcagacagtatatacacgaaccggtgctcgattttagcactcgcacgttgggtttggggggaagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagttccagcctgggggtcccagagactctcctgtgcagcctctgggctcaccgtcagcagcaactacatgagttgggtccgccaggctccagggaaaggggctggagtgggtctcagtcatttatactggtgatttcacatactacgcagactccgtgaagggccgattcaccatctccagggacaattccaggaaacacggtttatcttcaaatgaacaacctgagaggcggacgaacacggccgtctattactgtgcgagacaagtcggcgctcggagtggttatttcgtttgactttctggggccagggaaccctggtcaccgtcgcctccgcctccaccaagggccccatcggtcttccccctggcaccctcctccaagagcacctctgggggcacagcggccctggctgcctggtcaaggactacttcctatatactgtctgagccgggctgggcaaggcgcatag

SEQ ID NO: 793471 - DNA, 687 bp, Homo sapiens
  misc_feature: 68095.44.72.G06.1.pb.heavy.1.raw 68095
cgtatcgcctcccctccgcgccatcagaccagtatatacacgaccggtgctcgatttagctacgactgcaagggaaaggggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggcttgtccagcctgggggtccctgaactctcctgtgcagccttctggattcacctttagtagttattggatgaactgggtccgccaggctccagggaaggggctggagtgggtggccatcatgaagaaagatggaactgagacacactatgtggactctgtgacagggccgattcaccatctccagagacaacgccaagaactcactgtatctgcaaatgaacagtctgagagtcgaggacacggctgtggtattattgtgcgggaggcgctggtgctcattgactactggggtcagggaaccctgtcaccgtctctcagcctccaccaagggcccatcggtcttcccccttggcgccctgctccaggagcactccgagagcacagcggccctgggctgcctggtcaaggactacttcctatatactgtctgagcgggcaggcgcatag

SEQ ID NO: 793472 - DNA, 693 bp, Homo sapiens
  misc_feature: 68100.44.36.D03.1.pb.heavy.1.raw 68100
cgtatcgcctccctcgcgccatcagacagtatatacacgaccggtgctcgatttagctgcgtcacgatctctcttgggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtcactgggccagggaaccctggtcaccgtctcctcagcctccaccaagggcccatcgtcttccctggcgccctgctccaggagcacctcgagagcacagcgccctggctgcctggtcaaggactacttcctatatactgtctgagcgggctggcaaggcgcatag

SEQ ID NO: 793473 - DNA, 708 bp, Homo sapiens
  misc_feature: 68122.44.27.C05.1.pb.heavy.1.raw 68122
cgtatcgcctccctcgcgccatcagacagtatatacacgaccggtgctcgatttagacgcgatcgaagggtttgggggcctgggagacgagcccagcactggaagtcgccggtgtttccactcggtgatcatcactgaacacagaggactcaccatggagtttgggctgagctgggtttttcctcgttgccctctttaagagtgtcatgtgtcaggtgccaattcgtgggagtctgggggaggcggtggcccccagtaggggggtccctgagatctttctgtgcagcctctggattcaccttcgataattggaatatgcagtgggtccgccaggctccagcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctgcaaggcgcatag

SEQ ID NO: 793474 - DNA, 654 bp, Homo sapiens
  misc_feature: 68135.44.12.B01.1.pb.heavy.1.raw 68135
cgtatcgcctcctcgcgccatcagaagtatatacacgaccggtgctcgatttagtagtgtagattccgcggggctttctgagagtcatggacctcctgtgcaagacatgaagcacctgtggttcttcctcctgctggtggcggctcccagatgggtcctgtccagctgcagctgcaggagtcgggcccaggactggtgaagccttcggagaccctgtccctcacctgcactgtctctggtggctccatcagcagtagtagttactactgggctggatccgccagcccccagggaaggggctggagtggattggagtatctattatagtgggagcacctactacaacccgtcctcaagagtcgagtcaccatatcagtagacacgtccaagaaccagttctccctgaagctgagctctgtgaccgccgcggacacggccgtgtattactgtgcgagagtaggcagttcgtcaccaactacttgaccactggggccagggaaccctggtcaccgtctcctcagcctccaccaagggcccatcggtcttccccctggcaccctcctccaagagcacctctgggggcacagcggcctgggctgcctggtcaaggactacttcctatatactgtctgagcgggctggcaaggcgcatag

SEQ ID NO: 793475 - DNA, 574 bp, Homo sapiens
  misc_feature: 68147.44.78.H01.1.pb.heavy.1.raw 68147
cgtatcgcctccctcgcgccatcagacagtatatacacgaccggtgctcgatttagtgtgagtagtttgggtttgggtgccgaagttgctggaggtcacggtcaccacgctgctgagggtgaagaagcctggggcctcagtgacagtctcctgcacggcttctggatacacgttcatcaattatgatattaaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793476 - DNA, 548 bp, Homo sapiens
  misc_feature: 68152.44.43.D10.1.pb.heavy.1.raw 68152
ctatgcgcttgccagcccgctcagacagtatataggaagtagtccttgaccaggcagcccagggccgctgtgccccagaggtgctcctgggcagggcgccagggggaagaccgatgggcccttggtgaagctgaggagacggtgaccaagggttccctggcccccaggggtcgaaccacctcccgacgagcgctataccttcggatctcgccacagtaatacacggccgtgtcctcagatctcaggctgctcagctccatgtaggcttgtgtttatggaggtggttcctggtccatggtgactctgccctggaacttctgtgcatagctgtgttaccactgttagggttcatccatcccatccactcaagcccttggtccagtgcctgtcgcacccagttgatatcataatggtgaaggtgtatccagaagccttgcaggagaccttcactgaggccccaggcttcttcacctcaggccccttactgctagtctaaatcgagcaccggtcgtgtatatactgtctgatggcgcgagggaggcgatacg

SEQ ID NO: 793477 - DNA, 651 bp, Homo sapiens
  misc_feature: 68175.44.12.B01.1.pb.heavy.1.raw 68175
cgtatcgcctcctcgcgccatcagacagtatatacacgaccggtgctcgatttagtagtgtagattccgcggggctttctgagagtcatggacctcctgtgcaagaacatgaagcacctgtggttcttcctcctgctggtggcggctccagatgggtcctgtccagctgcagctgcaggagtcgggccaggactggtgaagccttcgagaccctgtccctcacctgcactgtctctggtggctccatcagcagtagtagttactactggggctggatccgccagcccccagggaaggggctggagtggattgggagtatctattatagtgggagcacctactacaacccgtcctcaagagtcgagtcaccatatcagtagacacgtcaagaaccagttctcctgaagctgagctctgtgaccgccgcggacacggccgtgtattactgtgcgagagtagggcagttcgtcaccaactactttgacactgggccagggaaccctggtcaccgtctcctcagcctccaccaagggccatcggtcttccccctggcaccctcctccaagagcacctctggggcacagcggcctgggctgcctggtcaaggactacttcctatatactgtctgagcgggctggcaaggcgcatag

SEQ ID NO: 793478 - DNA, 714 bp, Homo sapiens
  misc_feature: 68217.44.85.H08.1.pb.heavy.1.raw 68217
cgtatgcgcctccctcgcgccatcagacagtatatacacgaccggtgctcgatttagtatcactcaggtcgcggggagctctgggagaggagcccagcactagaagtcggcggtgttttccatcggtgatcagcactgaacacagaggactcaccatggagtttgggctgagctgggttttcctcgttgctcttttaagaggtgtccagtgtcaggtgcagctggtggagtctgggggaggcgtggtcccagcctgggaggtccctgagactctcctgtgcagcgtctggattcaccttcagtacctatggcatgcactgggtccgccaggctccaggcaaggggctggagtgggtggcacttatatggtatgatggaagtaataaatgactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaaggaccacggtcaccgtctcctcagcctccaccaagggcccatcggtcttccccctggcaccctcctccaagagcacctctgggggcacagcggccctgggctgcctggtcaaggactacttcctatatactgtctgagcggcggct

SEQ ID NO: 793479 - DNA, 642 bp, Homo sapiens
  misc_feature: 68222.UNK.UNK.UNK.pb.heavy.1.raw 68222
cgccgacacgcttgctagggacttggagctaaggacgacatattgccctttagacagtcgaaggtgacgccttagctaccactgaacgtttaggcgccagatgcggtctgggatgacctaactcgcagccttatcgatgatctactgcagcgctcaaccaaccaggtcttgatgcgcgcgcagtaggactgacgggagtcgcgctacagacatttaactcgctagtaacttaattgagatcctaggggatgggataggaaatagcaaatccaccccctatcaccccccccacatagcctgctctgcggggtggttgagtttacttttatttcgtgttggaatgaggttgaacttccgcggaagtggccgagtaatgggtttgtctacttcccctaaccgcaaagtacctagttttacgagtggcgttgcaagccatagccagtcacaggtaataaacaattcaaacgtggcgtaaagattggccgcttgctgtgggcattgcaagctgggtttggcagcattgtgcatgctgacgacgacatatgaatctgcgggacccctagtggccaagatgggccgctagcgggttgccgcagcttttgacctggaccaggggtgcatagcctgcccagccttcctcgc

SEQ ID NO: 793480 - DNA, 704 bp, Homo sapiens
  misc_feature: 68233.44.36.D03.1.pb.heavy.1.raw 68233
ctatgcgccttgccagcccgctcagacagtatataggaagtagtccttgaccaggcagcccagggccgctgtgctctcggaggtgctcctggagcagggcgccagggggaagaccgatgggcccttgtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793481 - DNA, 690 bp, Homo sapiens
  misc_feature: 68237.UNK.UNK.UNK.pb.heavy.1.raw 68237
ctatgcgcccttgccagcccgctcagacagtatataggaagtagtccttgaccaggcagcccagggccgctgtgcccccagagtgctcctggagcagggcgccagggggaagaccgatgggccttggtggaagctgaggtgacaatgaccagggttccctgccccagatctcaaggctccatgcgagctgggggtacggactctcgcacagtagtagacggccgtgtcgtcggatttcaaagaactcatctgtcatggagacttgtgtctgtggacttgtccgcggtaatcgtaattctgcccggaagtctcgtgcgtaggtgagtggaggccaaaaggggatgatccaccccatccactcaagcccttgtccaggggcctggcgcacccagttgatggtataagtagtggaaactggtagtactttccagaggccgtgcaggaaagggtcacccgaggaccaaggttgccggcattctagtcccagactgcaccagctgcaccagggactggacacctggttgctgctgccaccacaaagaaggaacctccaggtccagtccatggtgatgagctgtgctcccagggctttttagaggaggatgtggttgttatgtgatgctccccctgatagagctactaaatcgagcaccgtcgtgtatatactgtctgatggcgcgagggaggcga

SEQ ID NO: 793482 - DNA, 705 bp, Homo sapiens
  misc_feature: 68256.44.27.C05.1.pb.heavy.1.raw 68256
ctatgcgccttgccagcccgctcagacagtatataggaagtagtccttgaccaggcagcccagggccgctgtgctctcggaggtgctcctggagcagggcgccagggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatgtgaatcggccctcaacggaatcaccgtagacttgatttctccatgaaatgaccacactgccaccgactgccagcccctcgcctggagcctggcggaccactgcatattccaattatcgaaggtgaatccagaggctgcaacaggagagtctcagggaccccctactgggggccacgcctccccagactccacgaattgcacctgacacatgacacctcttaagagggcaacgaggaaaaacccagctcagcccaaactccatggtgagtcctctgttgttcagtgatgatcaccgagtggaaacaccggcgacttccagtgcttggctcgtctcccagggccccaaacccttcgatcgcgtctaaatcgagcaccggtcgtgtatatactgtctgatggcgcgagggaggcgatacg

SEQ ID NO: 793483 - DNA, 689 bp, Homo sapiens
  misc_feature: 68260.44.78.H01.1.pb.heavy.1.raw 68260
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactcccaggctttaccaaacctccccagactccaccaactgcacctcacactgggacaccttttaaaatagcagcaaggaaaatccagctcagcccaaactccatggtgagtcctctgtgttcagtcctgatcactgaatgaaaacacctgggaatcccaaggctgggctcctctcccagagctccccaaacccaaactactcacactaaatcgagcaccggtcgtgtatatactgtctgatggcgcgagggaggcgatacg

SEQ ID NO: 793484 - DNA, 659 bp, Homo sapiens
  misc_feature: 68273.UNK.UNK.UNK.pb.heavy.1.raw 68273
ctatgcgccttgccagcccgctcagacagtatataggaagtagtccttgaccaggcagcccagggccgctgtgccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgaggacgggttgtagtaggtgctcccactataatagatactcccaatccactccagccccttccctgggggctggcggatccagcccagtagtaactactactgctgatggagccaccagagacagtgcaggtgagggacagggtctccgaaggcttcaccagtcctgggcccgactcctgcagctgcagctggacaggacccatctgggagccgccaccagcaggaggaagaaccacaggtgcttcatgttcttgcacaggaggtccatgactctcagaaagccccgcggaatctacactactaaatcgagcaccggtagtgatagtatagactgatggcgcgagggaggcgatacg

SEQ ID NO: 793485 - DNA, 692 bp, Homo sapiens
  misc_feature: 68286.44.36.D03.1.pb.heavy.1.raw 68286
cgtatcgcctcctcgcgccatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctcagggaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaagggccatcggtcttcccctggcgccctgctccaggagcacctccgagagcacagcggccctgggctgcctggtcaaggactacttcctatatactgtctgagcgggctggcaggcgcatag

SEQ ID NO: 793486 - DNA, 641 bp, Homo sapiens
  misc_feature: 68298.UNK.UNK.UNK.pb.heavy.1.raw 68298
cgtatcgcctcctcgcgccatcagacagtatataccacgaccggtgctcgatttagtagtctcataagggaaatgctttctgagagtcaaggacctcctgtgcaagaacatgaagcactgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcagcccccagggagggaatggagtggattggtgacatccattatactgggcgacgtactactctccgtccctcaagagtcgtctcaccatttcgagggacacgtcatgaaccgcttctccctgaaactgacctccgtgaccgccgcggacacggccgtttatttctgtgcgaggcgagactggtctttcaatctatggggccgtggcaccctggtcactgtctcctcagcttcaccaagggccatcggtcttccccctggcgccctgctccaggagcacctctgggggcacagcggccctggctgcctggtcaaggactacttcctatatactgtctgagcgggctggcaaggcgcatag

SEQ ID NO: 793487 - DNA, 604 bp, Homo sapiens
  misc_feature: 68316.UNK.UNK.UNK.pb.heavy.1.raw 68316
acccgacacgcttgctagggacttggagctaaggacgacatattgcctttagacagtcgaaggtgacgcttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggttttgtctacttccctaaccgcaaagtactagttttacgagtggcgttgcaagccatagccagtcacaggtaataaacaattcaacgtggcgtaaagattgccgcttgctgtgggcattgcaagctggctttgcagcattgtgcatgctagacgacaatatgaatctgcggacccctagtggccaagatggccgctagcgggttccgcagcttttgacctggaccaggtgcatagcctgcccagcttc

SEQ ID NO: 793488 - DNA, 730 bp, Homo sapiens
  misc_feature: 68320.UNK.UNK.UNK.pb.heavy.1.raw 68320
cgtatcgcctccctcgcgccatcagacagtatatacacgaccggtgcttcgatttagacgcgatcgaagggtttggggcctgggagaacgagcccagcactgggaagtcgcggtgttttccactcgggtgatcatcactgaacacagaggactccaccatggagtttggctgagctgggttttcctcgttgccctcttaagaggtgtcatgtgtcaggttgcaattcgtggagtctggggagggggcgtggccccagtaggggggtccctgaagaccttcctgtgcagcctctggattcaccttcgataattggaatatgcagtgggttcccgccaggctccaggcgaggggctgggagtgggtggcaggtgtgtcatttcatggaggaaaatcaagtctacggtgattccgttgagggccgattccaccatctccagagggacaattccgagaacacagtggtctcttcaaatgaacagcctgagacctcaggacacggccgtgtattttttgttgcgagactatctgtttccaaaatcggttcattcggacgcctggggccagggaaaccctggtcaccgtctcctcggcctccacccagggcccatcggtcttccccctggcggccctgctccaggagcaacctccgaagagcacagcggccctgggctgcctggtccaaggactacttcctatatactgtctgagcgggctggcaagggcgcatag

SEQ ID NO: 793489 - DNA, 722 bp, Homo sapiens
  misc_feature: 68335.UNK.UNK.UNK.pb.heavy.1.raw 68335
ctatgcgccttgccagcccgctcagacagtatataggaagtagtccttgaccaggcagcccagggccgctgtgcccccagagggtggctcttggaggagggtgccagggggaagaccgatgggcccttggtgggaggctgaggagacggtgaccgtggtccttgggccccagacgtccataccgtagtagtagtcccagcaggtgtagtactacaatatgtcctcgcacagtaatacacagccgtgtcctcggctctcaggctgttcatttgcagatacagcgtgttctttggaattgtctctggagatggtgaatcggccttcacggagtctgcatagtatttattactttccatcataccatataagtgcacccactccagcccttgcctggagcctggcggaccccagtgcatgccataggtactgaaggtgaatccagacgctgcacaggagagtctcagggacctcccaggctggaccacgcctccccagactccaccagctgccacctgacactggacacctcttaaagagcaacgaggaaacccagctcagcccaaactccaatggtgagttccttcgtgttcagtgctgatccaccgaatggaaacacgccgactttctagtgctgggctcctctccccccgcgactgagtgatactaaatcgagcaccgtcgtcgtgtatatactgtctgatggcgcgaggaggggcgatacg

SEQ ID NO: 793490 - DNA, 606 bp, Homo sapiens
  misc_feature: 68349.UNK.UNK.UNK.pb.heavy.1.raw 68349
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgccagccttc

SEQ ID NO: 793491 - DNA, 612 bp, Homo sapiens
  misc_feature: 68358.44.38.D05.1.pb.heavy.1.raw 68358
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacggtgaccgtggtcccttggcccagacgtccataccgtagtagtagtatgcaactcccgaactcccgcaccggctcttgcacagtaatacacagccgtgtcctcggctctcagactgttcatttgcagatacagcgtgttcttggcgttgtctctgagatggtgaatcggcccttcacggagtccgcgtagcttgtgctactccatcactattaatacgtgagaccacaccagccccttccctggagcttggcggacccagtgcatccagtagctactgaaggtgaatccagaggctgcacaggagagtctcagggaccccccaggctgaactaagcctccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 793492 - DNA, 557 bp, Homo sapiens
  misc_feature: 68383.44.74.G08.1.pb.heavy.1.raw 68383
gaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccagggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccagggcttctttagaggaggaatgtggttgttatgtgatgctcccctgatagagctactaaatcgagcaccggtcgtgtatatactgtctgatggcgcgagggaggcgatacg

SEQ ID NO: 793493 - DNA, 639 bp, Homo sapiens
  misc_feature: 68388.44.19.B08.1.pb.heavy.1.raw 68388
cgtatcgcctccctcgcgccatcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagcccccggaaaggccctggagtggatcgcactcacttattggaatgacgatatacgatatagtccttctctgacgaccagactcacgctcacgaaggacacgtccaaaaaccaggtggtccttacattgaccacgtggaccctgtggacacaggcacatatttctgtgccacttcatgaccacaatgaccacgggcttcttcgaaccctgggccagggaatccaggtcaccgtctcatcagcctccaccaagggccatcggtcttccccctggcgccctgctccaggagcacctccgagagcacagcggccctgggctgcctggtcaaggactacttcctatatactgtctagcggctggcaaggcgcatag

SEQ ID NO: 793494 - DNA, 675 bp, Homo sapiens
  misc_feature: 68398.UNK.UNK.UNK.pb.heavy.1.raw 68398
cgtatcgcctccctcgcgccatcagacagtatatacacgaccggtggctcgatttagtgtcgtcgcaagagagagggcccagccctgggggactgaacagagagaactcaccatggagtttggggctgagctggctttttcttgtggctgttttaaaggtgtccagtgtgaagtgcagctgttggagtcggggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaataccggtgtttctgcagatgaagagcctgcgagtggacgacacggccctttattactgtgccagagggtcgcagaagttacaacaatacaagtattactactacatggacgtctggggcaaagggaccccggtcaccgtctctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 793495 - DNA, 732 bp, Homo sapiens
  misc_feature: 68400.44.85.H08.1.pb.heavy.1.raw 68400
cgtatcgcctccctcgcgccatcagacagtatataccacgaccggtgctcgatttagtatcactcagtcgcgggggggagaggagcccagccactagaaggtcggcggtgttttccattcggtgatcagcactgaacacagagggactcaccatggagtttgggctgagctgggttttcctcgttgctcttttaagaggtgtccagtgtcaggtgcagctggtggagtctgggggaggcgtggtccagcctgggaggtccctgagactctcctgtgcagcggtctggattcaccttcagtacctatggcatgcactgggtccgccaggctccaggcaaggggctggagtgggtggcacttatatggtatgatggaagtaataaatactatgcagactccgtgaaggggccgattcaccatctccagagacaatttccaagaacacggctggtatctgcaaatgaacagcctgagagccgaggaccacgcctgtgtatttactgtgcgaggacatattgtagtactaccacctgctgggactactactacggtatggacgtctggggccaagggacccacggtcaccgtctcctcagcctccaccaaggcccatcggtcttcccccctggcacccctcctccaagagcacctctgggggcacagcggccctgggctgcctggtcaaggactacttcctatatactgtctggagcgggctggcaaggcgcatag

SEQ ID NO: 793496 - DNA, 687 bp, Homo sapiens
  misc_feature: 68407.UNK.UNK.UNK.pb.heavy.1.raw 68407
cgtatcgcctcctcgcgccatcagacagtatatacacgaccggtgctcgattttgatcacataacaaccacactcctcctctaagaagcccctgggagcacagctcatcaccatggactgggacctggcggttcctcttgtgtggcagcagctacaggtgtccagtccaggtgcagctggtgcagtctgggctgagtgaagaagcctggtcctcggtgaaggtctcctgcaaggcttctggaggcaccttcttcagctatgctttatttgggttgcgacaggcccctggacaaggcttgagtggctgggagggatcatccctatctttggtgcatcgaattacgcacagaagtttcaggacagaggtcaccattaccgcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcataga

SEQ ID NO: 793497 - DNA, 707 bp, Homo sapiens
  misc_feature: 68410.UNK.UNK.UNK.pb.heavy.1.raw 68410
ctatgcgccttgccagcccgctcagacagtatataggaagtagtccttgaccaggcagcccagggccgctgtgctctcggaggtgctcctggagcagggcgccaggggaagaccgatgggcccttggtggaggctgaagagacggtcaccactgtccccggcccaagtactaaaggtgtcatgggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggcccccccagactccaacaactgcacttcacacacgacaccctttaaaaaagccacaagaaaaaggcagctcagcccaaactccatggagacttctctctgttcggtcctggtcaccaaatgaagacacctgaaaatccagggctgggctcctctctcagagctcccctttccctttatgcgactactaaatcgagcaccgtcgtgtatatactgtctgatggcgcgagggaggcgatacg

SEQ ID NO: 793498 - DNA, 677 bp, Homo sapiens
  misc_feature: 68415.UNK.UNK.UNK.pb.heavy.1.raw 68415
ctatgcgccttgccagcccgctcagacagtatataggaagtagtccttgacaggcagcccagggccgctgtgctctcggaggtgctctgagcagggcgccaggggagaccgatggcccttgtgaggctgagagacggtgaccaggggttccctgaccccagtagtcaatgagccacccagcgcctcccgcacataatacacagccgtgtcctcgactctcagactgttcatttgcagatacagtgagttcttggcgttgtctctggagatggtgaatcggccttcacagagtccacatagtgtgtctcagttccatctttcttcatgatggccacccactccagccccttcctggagcctggcggacccagttcatccaataactactaaaggtgaatccagaggctgcacaggagagtctcagggaccccccaggctggaccaagcctcccccagactccaccagttgcacctcacactggacaccttctaaatagcaacaaggaaaacccagctcagtcccaattccatggtgatcctctgtgctcagtgctgatcaccagtggaaaggccttggagtccagggctaaggctcctcttctcccctttccttgcagtcgtagctaaatcgagcaccggtcgcgtatatactgtctgatgcgcgaggaggcgatacg

SEQ ID NO: 793499 - DNA, 691 bp, Homo sapiens
  misc_feature: 68461.44.73.G07.1.pb.heavy.1.raw 68461
ctatgcgccttgccagcccgctcagacagtatataggaagtagtccttgaccaggcagcccagggccgctgtgctctcggaggtgctcctggagcaggcgccagggggaagaccgatgggcccttggtggaggctgaggagacggtgaccagggttccctggccccagtagtcagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgaagatgaatccagaggctgcacaggagagtctcagggagttccaggctggggccgctcctcccccagactccactagctgcacctgacactggccacctcttaaaagagcacgaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcggagggaggcgatacg

SEQ ID NO: 793500 - DNA, 710 bp, Homo sapiens
  misc_feature: 68467.UNK.UNK.UNK.pb.heavy.1.raw 68467
ctatgcgccttgccagcccgctcagacagtatataggaagtagtccttgaccaggcagcccagggccgctgtgctctcggaggtgctcctgggcagggcgccaggggaagacgatgggcccttggtggaggctgaagagacggtcaccactgtccccccgccccaatactaaaggtgtcatggggggtcaccgtggtcctggcttttcaaacagtaatagacgcctgtgtcctcggggtctcaggttttttcatttggagaaacaatttgtcctgcgaattgtccctggaaatggtgaagcggcccttcacggagtctccgtagaaagtgacaccaccagctccgatactgagacccactccagtcccctccctggagcccggcggacccaggtcatgccataggcactaaaggtgaatccagaggccgcacaggagagggtcagggacctcccaggccgaatcaggccccccccagactccaacaactgcacttcacacacgacaccctttaaaaaagccacaagaaaaaggcagctcagcccaaactccatggagacttctctctgttcggttcctggtcaccaaatgaagacacctgaaaatcccagggctgggctcctctctcagagctcccctttccctttatgcgactactaaatcggcaccggtcgtgtatatactgtctgatggcgcgagggaggcgatacg

SEQ ID NO: 793501 - DNA, 731 bp, Homo sapiens
  misc_feature: 68476.44.33.C11.1.pb.heavy.1.raw 68476
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggacccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793502 - DNA, 690 bp, Homo sapiens
  misc_feature: 68495.44.27.C05.1.pb.heavy.1.raw 68495
cgtatcgcctccctcgcgccatcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggggtccctgagactatcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagccctgagacctcaggacacggccgtgtatttttgtgcgagactatctgtttccaaaatcggttcattcgacgcctggggccagggaacccctggtcaccgtctcctcggcctccaccaagggccatcggtcttcccctggcgccctgctccaggagcacctccgagagcacagcggccctgggctgcctggtcaaggactacttcctatatactgtctgagcgggctgggcaggcgcatag

SEQ ID NO: 793503 - DNA, 718 bp, Homo sapiens
  misc_feature: 68502.UNK.UNK.UNK.pb.heavy.1.raw 68502
ctatgcgccttgccagcccgctcagacagtatataggaagtagtccttgaccaggcagcccagggccgctgtgcccccagaggtgctcttggaggagggtgccaggggggaagaccgatgggcccttggtggaggcggaggcgacggtgaccaagggttccctggccccagaagtcaaacgaataataaccactccggagcgccgactttgtctcgccaccagtaatagacggcccggtggtcgtcgcctctcaggttggttcatttgaagataaaccgtgttcctggaattgtccctggagatggtgaatcggccttcacggagtctgcgtagtatgtgaaatcaccagttataaatgactgaggacccactccagccccttccctggagcctggcgggacccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggcctcctctccccaaacccaacgtgcgagtgcctaaatcgagcaccggtcgtgtatatactgtctgatggccgcgagggaggcgatacg

SEQ ID NO: 793504 - DNA, 707 bp, Homo sapiens
  misc_feature: 68516.44.55.E11.1.pb.heavy.1.raw 68516
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggggctggagtgggtctcagtcatttatactggtgatttcacatactacgcagactccgtgaaggccgattcaccatctccagggacaattccaggaacacggtttatcttcaaatgaacaacctgagaggcgacgacacggccgtcctattactgtgcgagacaagtcggcgctcgagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggcctggcaaggcgcatag

SEQ ID NO: 793505 - DNA, 727 bp, Homo sapiens
  misc_feature: 68517.UNK.UNK.UNK.pb.heavy.1.raw 68517
cgtatcgcctccctcgcgccatcagacagtatatacacgacgggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtcagtgtcaggagcactttggtggagtctggggggagcgtggtccagccgggaggtccctgagactctcctgtgtagcctctgggttctcattcgatagatttggtttgcactgggtccgccaggctccagcaaggggccggagtgggtgcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaaatcataaactactactatttgatggatgtctgggggcagggggacgtcggtcaccgtctcctcagcttccaccaagggcccatcggtcttcccctggcgccctgctccaggagcacctctggggggcacagcggccctgggctgcctggtcaaggactacttcctatatactgtctgagcgggctggcaaggcgcatag

SEQ ID NO: 793506 - DNA, 695 bp, Homo sapiens
  misc_feature: 68523.44.27.C05.1.pb.heavy.1.raw 68523
tatgcgccttgccagcccgctcagacagtatataaggaagtagtccttgaccaggcagcccagggccgctgtgctctcggaggtgctcctggagcagggcgccagggggaagaccgatgggcccttggtggaggccgaggagacggtgaccagggttcctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagcccctcgcctggagcctggcggacccactgcatattccaattatcgaaggtgaatccagaggctgcacaggagagtctcaggaccccctactggggccacgcctcccccagactccacgaattgcacctgacacatgacacctcttaagagggcaacgaggaaaacccagctcagccaaactccatggtgagtcctctgtgtcagtgatgatcaccgagtggaaacaccggcgacttccagtgctggctcgtctcccagccccaaacccttcgatcgcgtctaatcgagcaccggtcgtgtatatactgtctgatggcgcgagggaggcgatacg

SEQ ID NO: 793507 - DNA, 709 bp, Homo sapiens
  misc_feature: 68528.44.55.E11.1.pb.heavy.1.raw 68528
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggactttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggttctcagtcatttatactggtgatttcacatactacgcagactccgtgaagggccgattcaccatctccagggacaattccgggaacacggtttatcttcaaatgaacaacctgagaggcgacgacacggccgtctattactgtgcgagacaagtcggcgctcggagtggttattattcgtttgacttctggggccaggaaccctggtcaccgtcgcctccgcctccaccaagggcccatcggtctttccccctggcaccctcctccaagagcacctctgggggcacagcggtcctgggctgcctggtcaaggactacttcctatatactgtctgagcgggctggcaaggcgcatag

SEQ ID NO: 793508 - DNA, 692 bp, Homo sapiens
  misc_feature: 68561.44.73.G07.1.pb.heavy.1.raw 68561
ctatgcgcctttgccaggccgctcagacagtatataggaagtagtccttgaccaggcagcccagggccgctgtgctctcggaggtgctcctggagcaggcgccagggggaagacgatgggccctttggtggaggctgaggagacggtgaccagggttccctggccccagtagtcaagcggggaccgtctcgagggggctctcgcacaataatagacagcgtgtcctcacttgttgaggttgtacatttgcagatgcagtgtgttcctggaattgtctctggagacggtgaatcggccttctcggagtctccgtagtgttcttcaattccatcttctgatataattgccacccactccagcccttgcctggagcctggcggacccagtgcatggcataggtcctgaagatgaatccagaggctgcacaggagagtctcagggagttcccaggctgggccggctcctcccccagactccactagctgcacctgacactggccacctcttaaaagagcaacgaggaaaacccatctcagcccaaagtccatggtgagtcctctgtgttcagtgatgatcaccgaatggaaacaccggcgacttccagtgctgggctcgtctccccccctgagcgtagagctaaatcgagcaccggtcgtgtatatactgtctgatggcgcgagggaggcgatacg

SEQ ID NO: 793509 - DNA, 656 bp, Homo sapiens
  misc_feature: 68569.UNK.UNK.UNK.pb.heavy.1.raw 68569
ctatgcgccttgccaggcccgctcagacagtatataggaagtagtccttgaccaggcagcccaggcgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggtctctggagacggagaatcggccctcacggagtttcatgtattctttactccatcagaccagatgactgccaccctccagcccttgctggagcctggcgacccagtgcatgcagagtcactgaactgagtcggacgcaacacaggagagtctcaggacgtcccaggctggaccacgcctcccagactccaccagctgaacctgacactggaactctaaaagagcaacgaggaaaaccagctcagcccaaactccatggtgagtcctctgtgttcagtgctggatcaccgaatgaaacaccgccgacttctagtgctggctcctctccagccctttcccttactgactcactaaatccgagcacggtcgtcgtatatactgtctgatggcgcgagggaggcgatacg

SEQ ID NO: 793510 - DNA, 591 bp, Homo sapiens
  misc_feature: 68596.UNK.UNK.UNK.pb.heavy.1.raw 68596
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggctcttcacctcagccccagactgcaccagctgtacctgggagtgggaccgtcagtcttcctcttccccccaaacccaaactactcacactaaatcgagcacccggtcgtgtatatactgtctgatggcgcgagggaggcgatacg

SEQ ID NO: 793511 - DNA, 656 bp, Homo sapiens
  misc_feature: 68633.UNK.UNK.UNK.pb.heavy.1.raw 68633
ctatgcgccttgccagcccgctcagacagtatataggaagtagtcttgaccaggcagccagggccgcgtgctctcggaggtgctcctggagcagggcgcaggggagaccgatggcccttgtggaggctgagagacgtgaccagggctcctggcccagtagaacgatggctcgtacaataatgagagccgagtcctcggctctcaattgttcatttgtagatacacgtgttctggaattgtctctggagacggagaatcgcccttcacggttcatagtattctttacttcatcagaccagatgactgccacccactcagcccttgcctggagcctggcggaccagtgcatggcagagtcactgaaactgagtccggacgcaacacagaggtctcagggacgtccaggctggacacggcctccccagactcacagctgaacctgacactggacacctcttaaaagagcaacgaggaaaaacccagctcagcccaaactccatggtgagtcctctgtgttcagtgctgatcaccgaatggaaaccaccgccgacttctagtgctgggctcctctccagccctttcccttactgactcactaatcgagcacgcgtcgtgtatactactgtctgatggcgccgagggaggcgatacgatcc

SEQ ID NO: 793512 - DNA, 639 bp, Homo sapiens
  misc_feature: 68662.44.86.H09.1.pb.heavy.1.raw 68662
ctatgcgccttgccagcccgctcagacagtatataggaagtagtccttgaccaggcagcccagggccgctgtgccccagaggtgctcctggagcagggcgccaggggaagaccgatgggccttggtggaagctgaggagacagtgaccagggtgccggcccatagattgaaagaccagtctcgcctcgcacagaataaacggccgtgtccgcggcgtcacggaggtcagtttcaggagaagcggttcatggacgtgtccctcgaaatggtgagacgactcttgagggacggagagtagtacgtcgccccagtataatggatgtcaccatccactccattcccctccctggggctgccggatccagcccaagaatgatcagaactgatggaaactccagagacagtgcagatgagagacagggttcccgaaggcctcaccagtcctgggcccgactcctgcagctgcacctgggacaggacccatctggagctgccaccagcaggaggaaaaccacaggtgcttcatgttcttgcacaggaggtccttgactctcagaagcatccccaaaccaagtctatagcactaaatcgagcaccggtcgtgtatatactgtctgatggcgcgagggaggcgatacg

SEQ ID NO: 793513 - DNA, 549 bp, Homo sapiens
  misc_feature: 68669.44.43.D10.1.pb.heavy.1.raw 68669
cgtatcgcctccctcgcgccatcagacagtatatacacgaccggtgctcgatttagactagcagtaaggggctgaggtgaagaagctgggggcctcagtgaagtctcctgcaaggtcttctggatacaccttcaccaattatgatatcaactggttgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacgggccgtgtattactgtgcgagatcccgaaagtatagcagctcgtcgggaggtggttcgacccctgggccaggaaaccctggtcaccgtctcctcagcttccaccaagggcccatcggtcttccccctggcaccctgctccaggagcacctctgggggcacagcggccctgggctgcctggtcaaggactacttcctatatactgtctgagcgggctggcaaggcgcatag

SEQ ID NO: 793514 - DNA, 687 bp, Homo sapiens
  misc_feature: 68679.44.73.G07.1.pb.heavy.1.raw 68679
ctatgcgccttgccagcccgctcagacagtatataggaaagtagtccttgaccaggcagcccagggccgctgtgctctcggaggtgctcctggagcagggcgccaggggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgtcctgaattgtctctggagacggtgaatcgggcccttctcggagtctccgtagtgttcttcaattccatcttctgatataattgccacccactccagccccttgcctggagcctgcggaccagtgcatggcataggtcctgaagatgaatccagaggctgcacaggagagtctcagggagttccaggctgggccgctcctcccccagactccactagctgcacctgacactggccacctcttaaagagcaacgaggaaaacccatctcagcccaaagtccatggtgagtcctctgtgttcagtgatgatcaccgaatggaaacaccggcgacttccagtgcgggctcgtctcccccctgagcgtagagctaatcgagcaccggtcgtgtatatactgtctgatggcgcgagggaggcgatacg

SEQ ID NO: 793515 - DNA, 726 bp, Homo sapiens
  misc_feature: 68686.44.67.G01.1.pb.heavy.1.raw 68686
cgtatcgccttccctcgcgccatcagacagtatatacacgaccggtgctcgatttagagtatacatattgggtttggggggggagaggagcccagcactgggattccgaggtgtttccattcggtgatcagcactgaacacagaggactcaccatggagttttggctgagctggggttctccttgtttggacttttaaaaggtgtccagtgtgaggtgcggctgatggagtctggaggaggctttagtccagcctgggggcgtcccagagacttctcctgtgcaggcctctgggctccgtcagccagccaactacatgagttggcggccgcaggctccagggaaagcgcggctggagtgggtctcagtcatttatactggtgatttcacatactaccgcagactccgtgaagggcccgattcaccatctcccagggacaattccaggaacacgggttatcttcaaatgaacaacctgagaggcgacgacaccggccgctctattactgtgcgaggacaagtcggcggctcggagtggttattattcgtttgacttctggggccagggaaccctggtcaccggtcgcctccgccctccaccaagggcccatcggtcttccccctggcaccctcctccaagagcaccatctgggggcacagcggccctgggctgccggtcaaggactacttcctatatactgtctgagcgggctggcaaggcgcatag

SEQ ID NO: 793516 - DNA, 687 bp, Homo sapiens
  misc_feature: 68709.UNK.UNK.UNK.pb.heavy.1.raw 68709
cgtatcgcctccctcgcgccatcagacagtatatacacgaccggtgctcgattttgatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggagcaccttcttcagctatgcttttatttgggtgcgacaggcccctggacaagggcttgagtggctgggagggatcatccctatctttggtgcatcgaattacgcacagaagtttcaggacagagtcaccattaccgcggacgaatccacgagtacagcctacatggagctgagcaggctgagatctgaagacacggccatctatttctgtgcgagagccctcgtcaactttcatagtccctctcatagtcccacacatggaaatggttcgaccctggggccagggaaccctggtcaccgtctcctcagcttccaccaaggcccatcggtcttcccctggcgccctgctccaggagcacctctggggcacagcggccctgggctgcctggtcaaggactacttcctatatactgtctgagcgggctggcaaggcgcatag

SEQ ID NO: 793517 - DNA, 658 bp, Homo sapiens
  misc_feature: 68710.44.12.B01.1.pb.heavy.1.raw 68710
ctatgcgccttgccagcccgctcagacagtatataggaatagtccttgaccaggcagcccagggccgctgtgcccccagaggtgctcttggaggagggtgccaggggaagacgatggcccttggtggaggctgaggagacggtgaccagggttccctggccccagtggtcaaagtagttggtgacgaactgccctactctcgcacagtaatacacggcgtgtccgcggcggtcacagagctcagcttcagggagaactggttcttggacgtgtctactgatatggtgactcgactcttgagggacgggttgtagtatgtgctcccactataatagatactcccaatccactccagcccttccctggggctggcggatccagccccagtagtaactactactgctgatggagccaccagagacagtgcaggtgagggacaggggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagccccgcggaatctacactactaaatcgagcaccggtcgtgtatatactgtctgatggcgcgagggaggcgatacg

SEQ ID NO: 793518 - DNA, 647 bp, Homo sapiens
  misc_feature: 68712.UNK.UNK.UNK.pb.heavy.1.raw 68712
cgtatcgcctcctcgcgccagtcgacagtatgatacacgaccggtgccgatttagtgagtcagtaaggggactccttgtgcccccaccatggacacactttgctccacgctcctgctgctgaccatcccttcatggggcctgtccagatcaccgtgaaagagtctgccctacattggtgaaacccacacagaccctcacgctgacctgcaccgtctcaggcttctcactcgtcactcctggagaggcgttgtctgggtgcggcagccccccggaaagccccggagtggatcgcactcacttatgggaatgacgatatacgatatagtccttctctgacgaccagactcatgctcacgaaggacacgtccaaaaaccaggtggtccttacattgaccaacgtggaccctgtggacacaggccatattctgtgcccacttcatgaccacaatgaccacgggcttcttcgaaccctggggccagggaatccaggtcaccgtctcatcagcctccaccaagggcccactcggtcttccccctaggcgccctgctccccaggagcaccttccgagagcacagcggccctgggctgcgcctggtcaaggaactacttcctatatactgtctgagcgggctggcaaggcgatag

SEQ ID NO: 793519 - DNA, 611 bp, Homo sapiens
  misc_feature: 68718.UNK.UNK.UNK.pb.heavy.1.raw 68718
ctatgcgccttgccagccgctcagacaggtatataggaagtagtccttgaccaggcagcccaggccgctgtgccccagaggtgctcggagcaggcgccagggggaagacgatggcccttgtgaagctggagacagtgaccagggtgcacggccatagattgaaagccagtctcgcctcgcagaaataacgccggtcgcggcgggtcacggaggtcagttcaggagaagcgtcatggacgtgtcctcgaaatgtgagacgactcttgagggacgagagtagtacgtcgccagtataatggatgtcaccaatccactccattcccctcctggggctgccggatccagccccagaatgatcagaactgatggaaactccagagacagtgcagatgagagacagggttccgaagcctcaccagtcctgggcccgactcctgcagctgcacctgggacaggaccatctgggagctgcaccgcaggaggaaaaaccacaggtgcttcatgttcttgcacaggaggtccttgactctcagaagccccaatccctaatcacgtgtactaaatcgagcacgtcgtgtatatactgtctgatggcgcgaggaggcgatacg

SEQ ID NO: 793520 - DNA, 618 bp, Homo sapiens
  misc_feature: 68725.44.38.D05.1.pb.heavy.1.raw 68725
cgtatcgcctccctcgcgccatcagacagtatatacacgaccggtgctcgatttagtatctgatagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggcccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 793521 - DNA, 706 bp, Homo sapiens
  misc_feature: 68732.UNK.UNK.UNK.pb.heavy.1.raw 68732
ctatgcgccttgccagcccgctcagacagtatataggagaagtagtcccttgaccaggcagccagggccgctgtgccccagaggtgctcttggaggagggtgccagggggaagaccgatgggccttggtggaggcgagccgacggtgaccagggttccctggccccagaagtcaaacgaataataaccactccgagcgccgacttgtctcgcacagtaatagacggccgtggtcgtcgcctctcaggttgttcatttgaagataaacggtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagaagtctctgggaccccccaggctggactaagcctcctccagactccatcagccgcacctcacactggacacctttttaaaagtccaacaaggagaacccagctcagccaaaactccatggtgagtctctgtgttcagtgctgatcaccgaatggaaacacctcggaatcccagtgctgggctcctctccccccaaaccaaacgtgcgagtgctaaatcgagcaccgtcgtgtatatactgtctgatggcgcgcggaggaggcgatacg

SEQ ID NO: 793522 - DNA, 708 bp, Homo sapiens
  misc_feature: 68738.44.56.F01.1.pb.heavy.1.raw 68738
ctatgcgccttgccagcccgctcagacagtatataggaagtagtccttgaccaggcagcccagggccgctgtgccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggaccaggccaagtgataatcactaagactgaatcctgagactacacaggagagtctcagagaccgccctggctgtgccaagccccccccgactccgccagtcgccctcgcactggacaccttctaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 793523 - DNA, 695 bp, Homo sapiens
  misc_feature: 68767.44.36.D03.1.pb.heavy.1.raw 68767
cgtatcgcctccctcgcgccatcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaaactcattgattctgcgaatgactaacctgaaaaccgaggacacgggcatgtattattgtgttgtggtttatatcaggaactgtccactggggccaggaaccctggtcaccgtctcctcagcctccaccaagggcccatcggtcttcccctggcgccctgctcaggagcacctccgagagcacagcggccctgggctgcctggtcaaggactacttcctatatactgtctgagcgggctggcaggcgcatag

SEQ ID NO: 793524 - DNA, 615 bp, Homo sapiens
  misc_feature: 68782.UNK.UNK.UNK.pb.heavy.1.raw 68782
ccgacacgcttgctagggattggagctaaggacgacatattgcctttagacagtcgaaggtgacgccttagctaccactgaacgtttaggcgccagatgcggtctgggatgacctaactcgcagcttatcgatgatctactgcacgctcaaaccaaccaggtcttgatgcgcgcgataggactgacgggatcgctacagacatttaactcgctagtaacttaattgagatcctaggggatgggataggaaatagaatccacccctatcacccccccacaatagcctgcttggggtgttgagtttacttttatttcgtgttggaatgagttgaacttccgggaagtggagtaatgggtttttgtctacttcccctaaccgcaaagtactagttttacgagtggcgttgcaagccatagccagtcacaggtaataaacaattcaaacgtggcgtaaagattggccgcttgctgtgggcattgcaagctgggtttttgcagcattgtgcatgctagacgacaatatgaatctgcgggacgccctagtgggccaagatggccgctagcgggttccgcagcttttgacctggaccagggtgcatagcctgcccagccttc

SEQ ID NO: 793525 - DNA, 698 bp, Homo sapiens
  misc_feature: 68785.UNK.UNK.UNK.pb.heavy.1.raw 68785
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggaccaactcatgtagttgctgctgacggtgagcccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctccccaaaccaacgtgcgagtgctaaatcgaagcaccggtcgtgtatatactgctgatggcgcgagggagggcgatacg

SEQ ID NO: 793526 - DNA, 703 bp, Homo sapiens
  misc_feature: 68796.44.36.D03.1.pb.heavy.1.raw 68796
cgtacgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagtttggtggagtccgggggagacttggtccagcctggaggtccctgagactctcctgtgtcgcctctgattcaccattcagtgaccactatatggactgggttccgccaggcttccagggaaggggctggagtggcttggccgcagtaaaaacaaagttgccagctttatcacagagtacgccgcgtctgtgaaagccagattcaccctctcaagagatgacttcaagaactcattgatctgcgaatggactaacctgaaaaccgagggacacgggcatgtattattgtgttgtgttttatcaggaactgtccactgggccagggaaccctggtcaccgtctcctcagcctccaccaagggcccatcggtccttcccctggcggccctgctccagagcacctccgagagcacagcggcctggctgcctggtcaaggactacttcctatatactgttctgagcggctggcaaggcgcatag

SEQ ID NO: 793527 - DNA, 711 bp, Homo sapiens
  misc_feature: 68806.44.73.G07.1.pb.heavy.1.raw 68806
ctaattgcgccttgcccagcgcccgctcagacagtatataggaagtagtccttgaccaggcagccagggccgctgtgctctcggaggtgctcctggagcagggcgccagggggaagaccgagggcccttggtggaggctgaggagacggtgaccagtgtccctggccccagtgaaacgcccgataatagctgctgcacttcccgatctcgcacagtaatacagagccgaggtcctcgcctctcaggctgatcatttccaggtacagagtgttccgggaattgtctctggagatggtgaatcggcccttcacggagtctgcataatatctagaagttccatcatatgctataactgccaaccactccgggcccttgcctggagcctggcggaccccagtgcatgccagaactactgaaaactaaatccagaggcttcacaggagagtctcagggagccgtcccaggctggaccacgcctcccccagactccaccaggtgcacctgacactggacacctcttaaagagtaacgaggaaaacccagctcagcccaaactcatggtgagtcctctgtgttcagtgctgatcaccgaatggaaacaccgccggacttctagtgctgggctcctctccagagctcgccctgagcgtagagctaaatcgagcaccggtcgtgtattttactgtctgatggcgcgagggaggcgatacg

SEQ ID NO: 793528 - DNA, 709 bp, Homo sapiens
  misc_feature: 68807.44.36.D03.1.pb.heavy.1.raw 68807
ctatgcgccttgccagcccgctcagacagtatataggaagtagtccttgaccaggcagcccagggccgctgtgctctcgggaggtgctcctggagcagggcgccagggggaagaccgatgggcccttggtgggctgaggagacggtgaccagggttccctggccccagtggacagttcctgatataaacacaacacataatacatgccgtgtcctcgggttttcaggttagtcattcgcagaatcaaaatgagttcttgaagtcattctcttgagagggtgaatctggctttcacagacgcggcggtactctgtgataaagctggcaactttgtttttactgcggccaagccactcccagccccttcccctggagcctggcgacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatattactgtctgatggcgcgagggaggcgatacg

SEQ ID NO: 793529 - DNA, 702 bp, Homo sapiens
  misc_feature: 68818.UNK.UNK.UNK.pb.heavy.1.raw 68818
cgtatcgcctccctccgcgccatcagacagtatatacacgacggtgctcgatttagacgcgatcgaagggtttggggagccctgggagacgagcccagcactggaagtcgccggtgtttccactcggtgatcatcactgaacacagaggactcaccatggagttttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccaggcgagggctggagtgggtggcaggtgtgtcatttcatggaggaaatcaagtctacggtgattccgttgagggccgattcaccatctccagagacaattccgagaacacagtgttctcttcaaatgaacagcctgagacctcagacacgccgtgtatttttgtgcgagactatctgtttccaaaatcggttcattcgacgcctggggccagggaaccctggtcaccgtctcctcggcctccaccaaggcccatcggtcttccccctggcgccctgctcaggagcacctccgagagcacagcggccctggctgcctggtcaaggactacttcctatatactgtctgagcgggctggcaggcgcatag

SEQ ID NO: 793530 - DNA, 555 bp, Homo sapiens
  misc_feature: 68871.44.78.H01.1.pb.heavy.1.raw 68871
cgtatcgctcctcgcgccatcagacagtatatacacgaccggtgctcgatttagtgtgagtagtttggtttgggtgccgaagttgctggagtcacggtcaccacgctgctgaggtgaagaagcctgggcctcagtgacagtctcctgcacggcttctggatacacgttcatcaattatgatattaactgggtgcgacaggccgctgacaaggctggagtggatggatggatgaagccctatagtggcaacacggctttgccagaagttccaaggcagagttagtatgaccaggagcacctccccagtacagtctacatggaactgagcagctgagatctgaggacacggccgtgtatttctgtgcgagagccaccagcacctggcttgacttgtggggccagggaaccctggtcaccgtctcctcagcctccaccaagggcccatcgtcttccctggcgccctgctccagagcacctccgagagcacagcggcctgggctgcctgtcaaggactacttcctatatactgtctgagcgggctggcaaggcgcatag

SEQ ID NO: 793531 - DNA, 617 bp, Homo sapiens
  misc_feature: 68874.UNK.UNK.UNK.pb.heavy.1.raw 68874
ctatgcgccttgccagcccgctcagacagtataaggaagtagtccttgaccaggcagcccagggccgctgtgcccccagaggtgctcctggagcagggcgccagggggaagaccgatgggcccttgggtggaagctgaggagacggtgaccgtggtccctttgccccagaccgtccagatggtaagacttataatacagaaaccagctgttcttctttcccgcattacccgtgcacagtaatatgtgcctgtgttccgcagggtccatgttggtcatactaaagaccacctgccttttggaggtgtccttggagatggttaaaactgctcttcagagatgtactgtaggatttttcgtcattcgagaagatgtgtgcaagccactccagggccttccctgggggctgacggatcagctcacacccattctaatatcgttgagagagaacccagagatggtgcaggtcagcggtgagggtctctgtgggtttcaccagcacaggaccagagactccttcaaggtgacctgggacaagacccaagagagatcgtgacgcagctaaatcgagccaccgcgtcgtgtatatactgtctgatggcgcgagggaggcgatacg

SEQ ID NO: 793532 - DNA, 648 bp, Homo sapiens
  misc_feature: 68935.44.86.H09.1.pb.heavy.1.raw 68935
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttgggcctggatccgcagcccccagggaggggaatggagtgattggtgacatccattatactggggcgacgtactactctccgtccctcagagtcgtctcaccatttcgaggacacgtccatgaaccgcttctccctgaaactgacctccgtgaccgccgcggacacggccgtttattctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaagactacttcctatatactgtctgagcgggctggcaaggcgcatag

SEQ ID NO: 793533 - DNA, 728 bp, Homo sapiens
  misc_feature: 68955.44.86.H09.1.pb.heavy.1.raw 68955
ctatgcgccttgccagcccgcctcagacagtatataggaagtagtccttgaccaggcagccccagggccgctgtgcccccagaggtgctctggaggagggtgccaggggggaagaccgatgggccttggtggaggctgaggagacggcgaccgtggtcccttggccccaggcgtccataccatttggagtagagcatgtcatatctgtatccacgagcccccatcctcgcacagtagtagacagccgtgtcctcggctcttcaggctatcatttccagatatagtgtgttctcgaattgtctctggagatggtgaatcgcccttcacggaatcacataatatttattacttccatcataccatataagtgccaccccactcccagtcccttgcctggagcctggcggacccagtgcatgccatgtctgttgaagggaatccagacgctacacaggagagtctcaggacctcccaggctggaccacgcctcccccagactccaccagcttcacctgaccactggacacctcttaaaagagcaacgaggaaaaccccaggtcagcccaaactccatggtgagtcctctgtgttcggtgctgatcaccgactggaaacaccgccgacttctggtgctgggctcctctcccagactcccaacccaagtctatagcactaaatcgagcaccggtcgtgtatatactgtctgatggcgcgagggaggcgatacg

SEQ ID NO: 793534 - DNA, 575 bp, Homo sapiens
  misc_feature: 68966.UNK.UNK.UNK.pb.heavy.1.raw 68966
ctatgcgccttgccagcccgctcagacagtatataggaagtagtccttgacaggcagcccaggccgctgtgctctcggaggtgctcctggagcagggcgccaggggaagaccgatggcccttggtggaggctgaggagacggtgaccagggttccctggccccacaagtcaagccaggtgctggtgctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagccttgtccagcggcctgtcgcacccagttaatatcataattgatgaacgtgtatccagaagccgtgcaggagactgtcactgaggccccaggcttcttcacctcagcccagactgcaccagctgtacctggagtggaccgtcagtcttcctcttcccccaaacccaaactactcacactaaatcgagcaccgtcgtgtatatatgatggcgcgaggaggcgatacg

SEQ ID NO: 793535 - DNA, 714 bp, Homo sapiens
  misc_feature: 68968.UNK.UNK.UNK.pb.heavy.1.raw 68968
cgtatcgcctccctcgcgccatcagacagtatatacacgaccggtgctcgatttagcacttcgcacgttggtttggggagaggagcccagcactgggattccgagggtgtttccattcggtgatcagcactggaacacagaggactcaccatggagttttggctgagctggggttctcccttgttggacttttaaaaaggtgtccagtgtgaggtgcggctgatggagtcctggaggaggcttagtccagcctggggggtcccagagactctctgtggcagcctctgggctcaccgtcagcagcaactacaatgagttgggtccgccaggctccagggaaaggggctggagtgggtctcaagtcatttatactggtgatttcacatactacgcagactccgtgaagggccgattcaccatctccagggacaattccaggaacacggtttatcttcaaatgaacaacctgagaggcgacgacacggccgtctattactgtacgagacaagtcggcgctcgggagtggttattattcgtttgacttctggggccagggaaccctggtcaccggtcgctccgctccaccagggcccatcggtcttccccctggccaccctccttccaagagcacctctggggggcacagcggccctgggctgcctggtcaaaggactacttcctatatactgtctgagcggctggcaaggcgcatag

SEQ ID NO: 793536 - DNA, 662 bp, Homo sapiens
  misc_feature: 68971.44.12.B01.1.pb.heavy.1.raw 68971
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaaagccttcggagacctgtccctcacctgcactgtctctggtggctccatcagcagtagtagttactactggggctggatccgccagcccccagggaagggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggcccgggctgcctggtcaaggacacttcctatatactgtctgaagcgggctggcaaggcgcatag

SEQ ID NO: 793537 - DNA, 668 bp, Homo sapiens
  misc_feature: 68990.44.45.E01.1.pb.heavy.1.raw 68990
cgtatcgcctccctcgcgccatcagacagtatatacacgaccggtgctcgatttagtgagtcagtaagggaaagggctgggagaggagcccagcactagaagtcggcggtgtttccattcggtgatcagcactgaaacacagaggactcaccatggagtttggctgagctgggtttcctcgttgctcttttaagaggtgtccagtgtcaggttcagctggtggagtctgggaggcgtggtccagcctggacgtccctgagactctcctgtgttgcgtccggactcagtttcagtgactctgccatgcactgggtccgccggctccaggcaaggggctgagtgggtggcagtcatctggtctgatggaagtaagaatactatggaaactccgtgaagggccggatctccgtctccagagacaattccaagaacaccgtgtatctacaaatgaacaatttgagagccgaggactcggctctctattattgtacgagcccatcgttctactgggccagggagccctggtcaccgtctcctcagcctccaccaagggcccatcgtcttcccctggcgccctgctcaggagcacctccgagagcacagcggccctggctgcctggtcaaggactacttcctatactgtctgagcgggctggcaaggcgcatag

SEQ ID NO: 793538 - DNA, 702 bp, Homo sapiens
  misc_feature: 69015.UNK.UNK.UNK.pb.heavy.1.raw 69015
ctatgcgccttgccagcccgctcagacagtatataggaagtagtccttgaccaggcagcccagggccgctgtgctctcggaggtgctcctggagcaggcgccagggggaagaccgatggcccttggtggaggctgaggagacggtgaccagggttccccggcccagtagtcaaaaccagccactgaccaagtggccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttcctggagcctggcggacccagttcatggcatagtcactgaagatgaatccagaggctgcacaggagagtctcagggacccccccgctgtaccaagcctccccagactccaccagccgcacctcacagtggacaccttctaaaatagcaacaaggaaaacccagcgcagccccaactccatggtgagtcctctgtgttcagtgctgatcaccaagtggaaatgccttggaatccagggctaaggcacctctctgagagctccaagagagatcgtgacgcagctaatcgagcaccgtcgtgtatatactgtctgatggcgcgagggaggcgatacg

SEQ ID NO: 793539 - DNA, 661 bp, Homo sapiens
  misc_feature: 69022.UNK.UNK.UNK.pb.heavy.1.raw 69022
cgtatcgctcctcgggccatcagacagtatatacacgaccggtgtcgatttagcactcgcacgttgggtttgggagaggagccagcactgggattccgaggtgtttccattcgtgatcagcactgaacacagaggactcaccatggagtttggctgagctgggttctccttgttgactttaaaaggtgtccagtgtgaggtgcggctgatggtctggagaggcttagtccagcctgggggtcccaggactctcctgtgcagcctctgggctcacgtcagcagcaactacatgagttgggtccgccaggctccagggaaaggctggagtgggtctcagtcatttatactggtgatttcacatactacgcagactcgtgaaggccgattcaccatctccaggacaattcaggacacggtttatcttcaatgacaacctgagaggcgacgacacggccgtctattactgtgcgagacaagtcggcgctcggagtggttatattcgtttgacttctggggcagggaaccctggtcaccgtcgccccgctccaccaggggccatcggtcttcccctgcaccctccaagagcacctctggggccagcggcctggctgctggtcaaggactacttcctatatactgctgagcggcggcaggcgcatag

SEQ ID NO: 793540 - DNA, 606 bp, Homo sapiens
  misc_feature: 69043.UNK.UNK.UNK.pb.heavy.1.raw 69043
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgatagggtggattctatttcctatcccatccctaggatctcaattaagttactagcgagttaaatgtctgtagcgatcccgtcagtcctatcgcgccgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 793541 - DNA, 647 bp, Homo sapiens
  misc_feature: 69053.44.23.C01.1.pb.heavy.1.raw 69053
ctatgcgccttgccagcccgctcagacagtatataggaagtagtccttgaccaggcagcccagggccgctgtgcccccagaggtgctcctggagcagggcgccagggggaagaccgatgggcccttggtgaagctgaggagacagtgaccagggtgccacggcccatagattgaaagaccagtctcgcctcgcacagaaataaacggccgtgtccgcggcggtcacggaggtcagtttcaggagaagcgttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgaggaggcgatacg

SEQ ID NO: 793542 - DNA, 763 bp, Homo sapiens
  misc_feature: 69056.UNK.UNK.UNK.pb.heavy.1.raw 69056
ctatgcgccttgccagccgctcagacagtatataggaagtagtccttgaccaggcagcccagggccgctgtgctctcggaggtgctcctggagcagggcgccagggggaagaccgatgggcccttggtggagctgaggagacggtgaccagggtttccctggccccagtggacagttcctgatataaacacaacacaataataacatgccgtgtcctcggtttcaggttagtcattcgcagaatcaatgagttcttgaagtcatctcttgagaggtgaatctggcttttcacagacgcggcgtactctgtgataaagctggcaactttgtttttactgcggccaagccacctccagccccttccctggagcctggcggacccagtccatatagtggtcactgatggtgaatccagaggcgacacaaggagagtctcagggaccctccaggctggaccaagtctccccggactccacaactgccacttcactctggacaccttggtaaaataaaacaaacaaggaaaaacccagctcagcccgaactcccatggtgagtcctctgtgttcagtgctgatcaccaaatgaaaaacacctgggaatttctgggggctggggctcccgctctcagagctcccccaagagagatcgtggacgcccccagctaaatcggagcaccggtcgtgtatattactggtctgatggcgcgaaggaccggtcgtgtatataactgtttctggatggcggcgagggaggcgatacg

SEQ ID NO: 793543 - DNA, 606 bp, Homo sapiens
  misc_feature: 69070.UNK.UNK.UNK.pb.heavy.1.raw 69070
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatggataggaaatagaatccacccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793544 - DNA, 710 bp, Homo sapiens
  misc_feature: 69075.UNK.UNK.UNK.pb.heavy.1.raw 69075
ctatgcgccttgccagcccgctcagacagtatataggaagtagtcttgaccaggcagcccagggccgctgtgcccccagaggtgctcttggaggagggtgccagggggaagaccgatggccccttggtggaggcggaggcgacggtgaccagggttccctggccccagagagtcaaacgaataataccactccgagcgccgactgtctcgcacagtaatagacgccgggcgcgtgtcgtcgcctctcaggttgttcatttgaagataaaaccgtgttcctggaattgtccctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccaaacccaacgtgcgagtgcaaatcgagcaccggtcgtgtatatactgtctgatggcgcgagggaggagcgatacg

SEQ ID NO: 793545 - DNA, 653 bp, Homo sapiens
  misc_feature: 69079.44.19.B08.1.pb.heavy.1.raw 69079
ctatgcgccttgccagcccgctcagacagtatataggaagtagtccttgaccaggcagcccagggccgctgtgctctcggaaggtgctcctggagcagggcgccagggggaagaccgatgggcccttggtggaggctgatgagacggtgacctggattccctgccccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccaggggcctttcccgggggctgccgcacccagacaacgccctctccaggagtgacgagtgagaagcctgagacggtgcaggtcagcgtgagggtctgggtgtgggttttcaccaatgtagggccagaactcttttcacggtgatctgggacaggccccatgaagggatgggtcagcagcaggaagcgtggagcaaagtgtgtccatggtggggcacaggagtcccccttactgactcactaaatcgagcaccggtcgtgtatatactgtctgatggcgcgaggaggcgatacg

SEQ ID NO: 793546 - DNA, 711 bp, Homo sapiens
  misc_feature: 69094.44.62.F07.1.pb.heavy.1.raw 69094
ctatgcgccttgccagcccgcttcagacagtatataggaagtagtcctttgaccaggcagcccagggccgctgtgctctcggaggtgcttcctggagcagggcgccagggggaagaccgatgggcccccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtccctcctggagcccggcggacccaggtcatgccataggcactaaaggtgaatccagaggccgcacaggagagggtcaggacctcccaggccgaatcaggccccccccgaactccaacaactgcacttcacacacgacacctttaaaaaagcacaagaaaaaggcagctcaggcccaaactccatggagacttctctctgttccggtcctggtcaccaaatgaagacacctgaaaatcccagggctgggctcctctctcagagctcccttcctttatgcgactactaaatcgagcaccggtcgtgtatatactgtctgatggcgcgagggaggcgatacg

SEQ ID NO: 793547 - DNA, 607 bp, Homo sapiens
  misc_feature: 69108.UNK.UNK.UNK.pb.heavy.1.raw 69108
ctatgcgccttgccagcccgctcagacagtatataggaatagtccttgaccaggcagccagggcgctgtgccccagagtgctcctggagcagggcgccaggggaagaccgatgggcccttggtggaagctgaggagacggtgaccgtggtcccttggcccagacgtccataccgtagtagtagtatgcaactccccgaactccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttcctggagcttggcggacccagtgcatccagtagctactgaaggtgaatccagaggcctgcacaggagagtctcagggaccccccaggctgaactaagcctccccggactccaccagctgcacctcacactggacacctttaaaatagcaacaaggaaaacccagctatcagatactaaatcgagcaccgtcgtgtatatactgtctgatggcgcgaggaggcgatacg

SEQ ID NO: 793548 - DNA, 725 bp, Homo sapiens
  misc_feature: 69133.44.20.B09.1.pb.heavy.1.raw 69133
ctatgcgccttgccagcccgctcagacagtatataggaaagttaagtcttgaccaggcagccaggccgctgtgctctcggaggtgctcctggagcagggcgccagggggaagaccgatgggcccttggtggaggctgaggagacggttgacccagggtcccctggccccagtcatttgcgcccggtaataactactaccacctccgatctcgcacagtaatacaaaaaagagccgagtcctcgactctcaggctgaccatttccaagtacacaatgtttccggaattgtctctggagatggtgaaatcgcccttcacggagtctgcataatattccagaacttccatcatgtgctataactgccaaccactccggcccttgcctggagcctggcggacccagtgcatgccagaaccactgaaactaaatccagaggcttcaacaggagagtctcaagggaccctcccaggcttggaaccaacgcctccccaagactccaccaggtgcaccctgacagtggacacctcttaaaagagcaacgaggaaaacccagctcagccaaactccatggtgaagtcctctgtgttcagtgctgatccaccgaatggaaacaccgccgacttctagtgctgggctcctctcccagacccctttccctcacactacactaaatcgagcaccggtcgtgtatatactgtctggatggccgcgagggaggcgatacg

SEQ ID NO: 793549 - DNA, 652 bp, Homo sapiens
  misc_feature: 69142.44.86.H09.1.pb.heavy.1.raw 69142
ctatgcgccttgccagcccgctcagacagtatataggaagtagtccttgaccaggcagccagggccgctgtgccccagaggtgctcctggagcagggcgccaggggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcggcgagggaggcgatacg

SEQ ID NO: 793550 - DNA, 704 bp, Homo sapiens
  misc_feature: 69205.UNK.UNK.UNK.pb.heavy.1.raw 69205
cgtatcgcctccctcgcgccatcagacagtatatacacgaccggtgctccgatttagacgcgatcgaagggtttgggggagcctggaaacggagcccagcactggaagtcgcccggtgttttcactcggtgatcatcactgaacacagaggactcaccatggagtttgggctgagctgggttttcctcgttgccctcttaagaggtgtcatgtgtcaggtgcaattcgtggagctgggaggcgtgccccagtagggggtccctgagactctcctgtgcagcctctggattcaccttcgtaattggaatatgcagtgggtccgccaggctccagggcaggcgagggctggagtgggtggcagtgtgtcatttcatggaggaaatcaagtctacgtgattccgttgaggggcgattcaccatctccagagacaattccgagaacacagtgtctcttcaaatgaacagcctgagacctcaggacacggcgtgtattttttgtgcgagactatctgtttccaaaatcggttcattcgacgcctggggccagggaaccctggtcaccgtctcctcgccctcaccaaggcccatcggtcttcccctgcgccctgctccaggagcacctccgagagcacagcgggccctgggctgcctggtcaaggactacttcctatatactgtctgagcggggctggcaaggcgcatag

SEQ ID NO: 793551 - DNA, 727 bp, Homo sapiens
  misc_feature: 69208.UNK.UNK.UNK.pb.heavy.1.raw 69208
ctatgcgccttgccagcccgctcagacagtatataggaagtagtccttgaccaggcagcccagggccgctgtgcccccagaggtgctcttggaggagggtgccagggggaagaccgatggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctctaaaagagcaacgaggaaaaacccaggtcagcccaaaactccatggtgagtcctctgtgttcggtgctgatcaccgactggaaacaccgccgacttctgtgctggctcctctcccagagctccccaaacccaacgagctcactctaaatcgagcaccgtcgtgtatatactgtctgatggcgccgaggaggcgatacg

SEQ ID NO: 793552 - DNA, 693 bp, Homo sapiens
  misc_feature: 69221.UNK.UNK.UNK.pb.heavy.1.raw 69221
ctatgcgccttgccagcccgctcagacagtatataggaagtagtccttgacaggcagccagggccgctgtgccccagaggtggctcttggagtagggtgccagggggaagaccgatgggcccttggtggagcggaggcgacggtgaccagggttccctggccccagaagtcaaacgaataataaccactccgagcgccgacttgtctcgcacagtaatagacggcgtgtcgtcgcctctcaggttgttcatttgaagataaaccgtgttcctggaattgtccctggagatggtgatcgccttcacggagtctgcgtagtatgtgaaatcaccagtataaatgactgagacccactcagccccttcctggagcctggcggacccaactcatgtagttgctgctgacggtgagcccagaggctgcacaggagagtctctggaccccccaggctggactaagcctcctccagactccatcagccgcacctcacaactggacaccttttaaaagtccaacaaggagaaccccagctcagccaaactccatgtgagtcctctgtgttcagtgcgatcaccgaatggaaacacctcggaatcccagtgctgggctcctctccccccaaacccaacgtgcgagtgcaatcgagcaccggtcgtgtatatactgtctgatggcgcgagggaggcgattacg

SEQ ID NO: 793553 - DNA, 682 bp, Homo sapiens
  misc_feature: 69225.44.45.E01.1.pb.heavy.1.raw 69225
ctatgcgccttgccagcccgctcagacagtatataggaagtagtccttgaccaggcagcccaggccgctgtgctctcggaggtgctcctggagcagggcgccaggggaagaccgatgggcccttggtggaggctgaggagacggtgaccagggctccctggccccagtagaacgatgggctcgtacaataatagagagccggagtcctcggctctcaaattgttcatttgtagatacacggtgttcttggaattgtctctggagacggagaatcggcccttcacggagtttccatagtattctttacttccatcagaccagatgactgccacccactccagccccttggcctggagcctggcggacccagtgcatggcagagtcactgaaactgagtccggacgcaacacaggagagtctcagggacgtcccaggctggaccacgcctcccccagactcaccagctgaacctgacactggacacctcttaaaagagcaacgaggaaaacccagctcagcccaaactccatggtgagtcctctgtgttcagtgctgatcaccgaatggaaacacgccgacttctagtgctggggctcctctcccagcccctttcccttactgactcactaaatcgagcaccggtcgtgtatatactgtctgatggcgcgagggaggcgatacg

SEQ ID NO: 793554 - DNA, 704 bp, Homo sapiens
  misc_feature: 69228.44.55.E11.1.pb.heavy.1.raw 69228
cgtatcgcctccctcgcgccatcagacagtatatacacgaccggtgctcgattttagcactcgcacgttgggtttggggggggagaggagccagcactgggattccgaggtgttttccattcgggtgatcagcactgaacacagaggactcaccatggagtttggctgagctggggtttctgttggactttttaaggtgtccagtgtgaggtgcggctgatggagtctggaggaggcttagtcccaagcctgggtccagagactctcctgtgcagcctctgggctcaccgtcagcagcactacatgagttgggtccgccaggctccagggaaggggctggagtgggtctcagtcatttatactggtgatttcacatactacgcagactccgtgaagggccgattcaccatctccagggacaattccaggaacacggttttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctggcctggtcaaggactacttcctatatactgtctgagcgggctggcaaggcgcatag

SEQ ID NO: 793555 - DNA, 652 bp, Homo sapiens
  misc_feature: 69245.44.23.C01.1.pb.heavy.1.raw 69245
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaactccagagacagtgcagatgagagacagggttcccgaaggcctcaccagtcctgggcccgactcctgcagctgcacctgggacaggacccatctgggagctgccaccagcaggaggaaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 793556 - DNA, 695 bp, Homo sapiens
  misc_feature: 69253.44.6.A06.1.pb.heavy.1.raw 69253
tatcgccctccctcgcgccatcagaccagtatatatcacgaccggtgctcgatttagatctactgacaaaccacattcctcctctaaagaagcccctgggagcacagctcatcaccatggactggacctggaggttcctcttgtggtggcagcagcaacaggtgtccagtccctggtgcaactggtgcagtctgggactagaatgccgcaaccttggtcctcggtgccctttcctgcacggcctctggaagtactaccagttcactacttataccatcaactgggtgcgccaggcccctggacaagggcttgagtggatgggtggaatcatcctctttttggctcactcacctacgcacgagacttccgggcagaatacgatacgataccgcggacaagtccacagacaccaggtctccatgacaatgagttctttgaaatccgacgacacggccgttactactactgtgcgagaggatccggtacgcccagctcgcagggagcctttgagatctgggggcaggaaccctcggtcattgtcatggttcatcagctttccaccaagggcccatcggtcttccccctggcgccctgctccaggagcacctctggggcacagcggccctggctgcctggtcaaggactgacttcctatatttgtgctgtcgtctgagcggcgctggcaaggcgcatag

SEQ ID NO: 793557 - DNA, 685 bp, Homo sapiens
  misc_feature: 69263.44.45.E01.1.pb.heavy.1.raw 69263
ctatgcgccttgccagcccgctcagacagtatatggaagtagtccttgaccaggcagcccagggccgctgtgctctcggaggtgctcctggagcagggcggccagggggaagaccgatgggcccttgtggaggctgaggagacggtgaccagggctccctggccccagtagaacgatgggctcgtacaataatagagagccgagtcctcggctctcaaattgttcatttgtagatacacggtgttcttggaattgtctctggagacggagatcggcccttcacggagtttccatagtattctttacttccatcgagcaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggggcgcgagggaggcgatacg

SEQ ID NO: 793558 - DNA, 726 bp, Homo sapiens
  misc_feature: 69266.44.86.H09.1.pb.heavy.1.raw 69266
ctatgcgccttgccagcccgctcagacagtatataggaagtagtccttgaccaggcagcccagggccgctgtgcccccagaggtgctcttggaggaagggtgccaggggaagaccgatgggcccttggtggaggctgaggagacgcgaccgtggtcccttggccccaggcgtccataccattggagtagagcatgtcatatctgtatccacgagccccatctctcgcacagtagtagacagccgtgtctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctcccaacccaagtctatagcactaaatcgagcaccggtcgtgtatatactgtctgatggcgcgagggaggcgatacg

SEQ ID NO: 793559 - DNA, 696 bp, Homo sapiens
  misc_feature: 69271.44.27.C05.1.pb.heavy.1.raw 69271
ctatgcgccttgccagcccgctcagacagtatataggaagtagtccttgaccaggcagcccagggccgctgtgctctcggaggtgctcctggagcagggcgccaggggaagaccgatggcccttggtggaggccgaggagacggtgaccagggttccctggcccaggcgtcgaatgaaccgatttggaaacagatagtctcgcacaaaaatacacggccgtgtcctgaggtctcaggctgttcatttgagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaggtgaatccagaggctgcacaggagagtctcagggacccccctactggggccacgcctccccagactccacgaattgcacctgacacatgacacctcttaagagggcaacgaggaaaacccagctcagcccaaactccatggtgagtcctctgtgttcagtgatgatcaccgagtggaaacacggcgacttccagtgctgggctcgtctcccagccccaaacccttcgatcgcgtctaaatcgagcaccggtcgtgtatatactgtctgatggcgcgagggaggcgatacg

SEQ ID NO: 793560 - DNA, 701 bp, Homo sapiens
  misc_feature: 69273.44.27.C05.1.pb.heavy.1.raw 69273
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggcctcaacggaatcaccgtagacttgatttcctccatgaaatgacacacctgccacccactccagcccctcgcctggagcctggcggaccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaaccttcgatcgcgtctaaatcgagcaccggtcgtgtatatactgtctgatggcgcgagggaggcgatacg

SEQ ID NO: 793561 - DNA, 607 bp, Homo sapiens
  misc_feature: 69300.44.36.D03.1.pb.heavy.1.raw 69300
cgtatcgcctccctcgcgccatcagacagtatatacacgaccggtgctcgatttagctgcgtcacgatctctcttgggtcttgtcccaggtcaccttgaaggagtctggtcctgtgctggtgaaaccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtccttaccatctggacgtctggggcaaagggaccacggtcaccgtctcctcagcttccaccaagggcccatcggtcttccccctggcgccctgctccagagcacctctgggggcacagcggccctgggctgcctggtcaaggactacttcctatatactgtctgagcgggctggcaaggcgcatag

SEQ ID NO: 793562 - DNA, 700 bp, Homo sapiens
  misc_feature: 69317.UNK.UNK.UNK.pb.heavy.1.raw 69317
cgtatcgcctccctcgcgccatcagacagtatatacacgacggtgctcgattagcactcgcacgttgggtttgggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtgttattattcgtttgacttctggggccagggaaccctggtcaccgtcgcctccgcctccaccaagggcccatcggtcttccccctggcaccctcctccaagagccacctctggggcacagcgccctgggctgcctggtcaaggactacttcctatatactgtctgagcgggctggcaaggcgcatag

SEQ ID NO: 793563 - DNA, 700 bp, Homo sapiens
  misc_feature: 69345.44.36.D03.1.pb.heavy.1.raw 69345
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaatctggctttcacagacgcggcgtactctgtgataaagctggcaactttgttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctgggctccgctctcagagctccccaagagagatcgtgacgcagctaaatcgagcaccggtcgtgtatatactgtctgatggcgcgagggaggcgatacg

SEQ ID NO: 793564 - DNA, 708 bp, Homo sapiens
  misc_feature: 69394.44.62.F07.1.pb.heavy.1.raw 69394
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggcccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccatgggcactaaggtgaatccagaggccgcacaggagagggtcaggacctcccaggccgaatcaggccccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatag

SEQ ID NO: 793565 - DNA, 671 bp, Homo sapiens
  misc_feature: 69408.44.12.B01.1.pb.heavy.1.raw 69408
cgtatcggcctccctcgcgccatcagacagtatatacacgaccggtgctcgatttagtagtgtagattccgcggactttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacctgtccctcacctgcactgtctctggtggctcatcagcagtagtagttactactgggctggatcccggccgcgcccccagggaaaggggctggagtggattgggagtatctattatagtgggagcacctactacaacccgtccctcaaagagtcgagtccaccatatcagtagacacgtccagaaaaccagttctccctgaaagctgagctctgtgaccgccgcggacaccggccgtgtattactgtgcgagaggtagggcagttcgtcaccaactaactttgaccactggggccaggaacctgtcaccgtctcctcagcctccaccaagggccccatcgtcttccccctggcaccctcctccaagagcacctctcggcacagcggccctggcctgcctggtcaaggactacttccatatactcgtctgagccggctggcgcaaagccgcatagg

SEQ ID NO: 793566 - DNA, 707 bp, Homo sapiens
  misc_feature: 69412.44.36.D03.1.pb.heavy.1.raw 69412
cgtatcgcctgccctcgcgccatcagacagtatatacacgaccggtgctcgatttagctgcgtcacgcatctctcttgggagctctgagagccggagccccagcccagaattcccaggtttttcattttgtgatcagcactgaacacgaggactcaccgatgcgacgttcgggctgagctgggtttcccttgttgttatttaaacaggtgtccagagtgaagtgcagttggtgggagtcccgggggagactggtccagcctggaggggtcctgaactctcctgtgtcgcctctggattcaccatcagtgaccactatatggactggggtccgcagggctcccagggagggggctggagtggcttggccgcagtaaaaacaaagttgccagctttatcacagagtacgccggtctgtgaaagcagattcaccttctcaagagatgacttcaagaactcattgattctgcgaatgactaacctgaaaaccgaggacacccggcatgtattattgtgttgtgtttatatcaggaactgtccactgggccagggaaccctggtcaccgtctcctcagcctccaccaagggcccatcggtcttcccctggcgccctgctccaggagcacctccgagagcacagcggccctgggcctgcctggtcaaggactacttcctatatactgtctgagcgggctggcaaggcgcatag

SEQ ID NO: 793567 - DNA, 697 bp, Homo sapiens
  misc_feature: 69447.44.36.D03.1.pb.heavy.1.raw 69447
cgtatcgcctcctcgcgccatcagacagtatatacacgaccggtgctcgatttagctgcgtcacgatctctcttggggagctctgagagcggagccccagccccagaattcccaggtgttttcattttggtgatcagccactgaacacagaggactcaccatggagtcgggctgagctgggttttcttgttgttattttacaaggtgtcagagggaagtgcagttggtggagtccgggggagacttggtccaggcctggaggtcctgagacctcctgggtcgcctctggattcaccatcagtgaccactatatggactgggtccgcaggctccagggaaggggctggagtggcttggcgcagtaaaacaaagttgccagctttatcacagagtacgccgcgtctgtgcaaagccagattcacctctcaagagatgacttcaagaactcattgattctgcgaatgactaacctgaaaacgaggacacgggcatggtattattgtgttgtgtttatatcaggaactgtccactgggggccagggaaccctggtcaccgtctcctcagcctcaccaagggcccatcgtcttcccctggcgccctgctccaggagcacctccgagagcacagcggcctcgggctgcctggtcaaggacttacttcctatatactgtctgagcgggctggcaaggcgcatag

SEQ ID NO: 793568 - DNA, 637 bp, Homo sapiens
  misc_feature: 69448.UNK.UNK.UNK.pb.heavy.1.raw 69448
cggtatcgcctcctcgcgccatcagacagtatatacaccgacggtgctcgatttagtacaacgtgattagggaattggggctttctgagagtcaaggacctcctgtgcaagaacatgaagcacctgtgtttttcctcctgctggtggcagccttccagatgggtcctgtccaagtgcagcctgcagagtcgggccaaggactggtgaggccttcggaaccctgtctctcatctgcactgtctctggagtttccatcagttctgatcattcttgggctggatccggcagccccagggaggggaatggatgattggtgacatccatatactggccgacgtactacctccgtccctcaagagtcgtctcaccatttcgagggacacgtcatgaaccgctttcctgaaactgacctccgtgaccgccgcggacaccggccgtttatttctgtgcgaggcgagactggtctttcaattctatggccgtggcaccctggtcactgtctcctcagcttccaccaaggccatcggtcttcccctggcgccctgctccaggagcacctctggggcacagcggccctgggctgcctggtcaaggactacttcctatatactgtctgagcgggctggcaagcgcatag

SEQ ID NO: 793569 - DNA, 591 bp, Homo sapiens
  misc_feature: 69469.44.78.H01.1.pb.heavy.1.raw 69469
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggccccacaagtcaagcccaggtgctggtggctctcgcacagaaatacacggccgtgtcctcagatctcaggcctgctcagttccatgtagactgtacctggggaggtgctcctggtcatactaactctgccttggaacttctggcaaagcccgtgttgccactatagggcttcatccatcccatccactccagcccttgtccagcggcctgtcgcacccagtttaatatcataattgatgaacgtgtatccagaagccgtgcaggagactgtcactgaggccccaggcttcttcacctcagcccagactgcaccagctgtacctgggagtgggaccgtcagtcttcctcttccccccaaacccaactactcacactaaatcgagcaccggtcgtgtatatactgtctgatggcgcgagggaggcgatacg

SEQ ID NO: 793570 - DNA, 703 bp, Homo sapiens
  misc_feature: 69495.UNK.UNK.UNK.pb.heavy.1.raw 69495
cgtatcgcctccctccgcgccatcagacagtatatacaacgaccgggctcgatttagcactcgcacgttgggtttgggggagaggagcccagcactgggattccgagggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccccagagactctcctgtgcagcctctgggctcaccgtcagcagcactacatgagttgggtccgccagctccagggaaggggctgagtgggtctcagtcatttatactggtgatttcacatactacgcagactccgtgaagggccgattcaccatctccaggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctcccgcctccaccaagggccatcggtcttccccctggcaccctcctccaagagcacctctgggggcacagcggccctgggctgcctggtcaaggactactttcctatatactgtctgagcgggctggcaaggcgcatag

SEQ ID NO: 793571 - DNA, 654 bp, Homo sapiens
  misc_feature: 69502.44.57.F02.1.pb.heavy.1.raw 69502
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793572 - DNA, 661 bp, Homo sapiens
  misc_feature: 69508.UNK.UNK.UNK.pb.heavy.1.raw 69508
ctatgcgccttgccagcccgctcagacagtatataggaagtagtccttgaccaggcagcccagggccgctgtgctctcgaggtgctcctggagcagggcgccaggggaagaccgatgggccttggtggaggctgaggagacggtgaccagggttccctggccgaatgaaaccatcccagacagtaatagacggctgtgtcctcggtgtcaggctgttcatctgcagagacaccgtatcttgaatcatctcttgagatggtgaatctgcctttcacggtgcagcgtagtctgctgtcccaccgtcagctttggttctaatacggccaacccactccagccccttccctgagcctggcggacccaggtcatcaggcgttactgaagtgaatccagagctgcacaggagagtctaaggactccccaggctttaccaaactcccccagactccaccaactgcacctcacctggacaccttttaaatagcagcaagaaaatccagctcagcccaaactccatggtgagtcctctgtgttcagtcctgatcactgaatgaaaacacctggaatcccaaggctgggctcctctccagagctcaacacactctctctaaatcgagcacggtcgtgtatatactgtctgatggcgcgaggaggcgatacg

SEQ ID NO: 793573 - DNA, 687 bp, Homo sapiens
  misc_feature: 69526.UNK.UNK.UNK.pb.heavy.1.raw 69526
ctatgcgcctgccagcccgctcagacagtatataggaagtagtcctgaccaggcagcccaggggcgctgtgcccagaggtgctcctggagcagggcgccagggggaagaccgatggcccttggtggaagctgaagagacggtgaccattgtcccctggccccaaatatcaaatgcatcgacgtcccaggatcgcctggcgcgtataacgcctgtgtcgtcggtctcaggttgctcatttgtaaatggccaacactgttgagtccatccttgagacggtgaatcttccctcacagacgcggcggtactctttacttccaccataacgtttcattctgaccgaaagtgatccactcaagccccttccctggagcctgacggacccaggccaagtgataatcactaagactgaatcctgagactacacaggagagtctcagagacccgccctggctgtgccaagccccccgactccgccagtccgcccctcgcactggacaccttctaaaaaaactacaaggaaaatcaagattagcccaaactccatggttggtggtctgtgctcagtgctgatcaccaagtggaaactcctgggaatctccacggctgggctccttctctcttgcgacgacactaaatcgagcacccggtcgtgtatatctgtctgatggcgcgagggaggcgatacg

SEQ ID NO: 793574 - DNA, 690 bp, Homo sapiens
  misc_feature: 69532.44.36.D03.1.pb.heavy.1.raw 69532
ccgctcagacagtatataggaaagtagtccttgaccaggcagccccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgttttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793575 - DNA, 614 bp, Homo sapiens
  misc_feature: 69533.UNK.UNK.UNK.pb.heavy.1.raw 69533
gagggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaaatctttacgccacgttgaattgtttattacctgtgactggctatggcttgcaacgccactcgtaaaactagtactttgcgttaggggaagtagacaaaccccattactccacttccgggaagttcaactcattccaacacgaaataaaagtaaactcaacaccccaagcaggctatgtggggggcggtgataggggtggattctatttcctatcccatcccctaggatctcaattaagttactaagcgagttaaatgtctgtagccgaatcccgtcagtcctatcgcgccgcaatcagacctgttggttgagcgtgcagtagatcatcgataagctgcgagttaggtcatcccagaccgcatctggcgcctaaaacgttcagtggtagctaggcgtcacctcgactgtctaaagggcaatatgtcgtccttagctccaagtccctagcaagcgtgtcggg

SEQ ID NO: 793576 - DNA, 709 bp, Homo sapiens
  misc_feature: 69540.44.27.C05.1.pb.heavy.1.raw 69540
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccaccccactccagcccctcgcctggagcctggcgacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagggctccccaaaacccttcgatcgcgtctaaatcgagcaccggtcgtgtatatactgtctgatggcgcgagggaggcgatacg

SEQ ID NO: 793577 - DNA, 641 bp, Homo sapiens
  misc_feature: 69570.UNK.UNK.UNK.pb.heavy.1.raw 69570
ctatgcgccttgccagcccgctcagacagtatataggaaagtagtccttgaccaggcagcccagggccgctgtgctctcggaggtgctcctggagcagggcgccagggggaagaccgatgggcccttggtggaggctgatgagacggtgacctggattccctggccccagggttcgaagaagcccgtggtcattgtggtcatgaagtgggcacagaaatatgtgcctgtgtccacagggtccacgttggtcaatgtaaggacacctggtttttggacgtgtccttcgtgagcgtgagtctggtcgtcagagaaggactatatcgtatatcgtcattccaataagtgagtgcgatccactccagggcctttccgggggctgccgcacccagacaacgccctctccaggagtgacgagtgagaagcctgagacggtgcaggtcagcgtgagggtctgtgtgggtttcaccaatgtagggccagactctttcacggtgatctggacaggcccatgaagggatggtcagcagcaggagcgtggagcaaagtgtgtccatggtggggcacaggagtccccttactgactcactaaatcgagcaccggtcggtatatactgtctgatggcgcgagggaggcgatacg

SEQ ID NO: 793578 - DNA, 662 bp, Homo sapiens
  misc_feature: 69578.44.12.B01.1.pb.heavy.1.raw 69578
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccacagcaggaggaagaaccacaggtgcttcatgttcttgcacaggaggtccatgactctcagaaagccccgcggaatctacactactaaatcgagcaccggtcgtgtatatactgtctgatggcgcgagggaggcgatacg

SEQ ID NO: 793579 - DNA, 676 bp, Homo sapiens
  misc_feature: 69582.UNK.UNK.UNK.pb.heavy.1.raw 69582
ctatgcgccttgccagcccgctcagacagtatataggaagtagtccttgaccaggcagcccagggccgctgtgccccagaggtgctcctggagcagggcgccagggggaagaccgatgggcccttggtggaagctgaggtgacaatgaccagggttccctgcccccagatctcaaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcacagttgcaccagggactggacacctgttgctgctgccaccacaaagaggaacctccaggtccagtccatggtgatgagctgtgctcccaggggcttctttagaggaggaatgtggttgtcagtagatctaaatcgagccaccggtcgtgtatatactgtctgatggcgcgagggaggcgatacg

SEQ ID NO: 793580 - DNA, 708 bp, Homo sapiens
  misc_feature: 69588.44.56.F01.1.pb.heavy.1.raw 69588
ctatgcgccttgccagcccgctcagacagtatataggaagtagtccttgaccaggcagccagggcgctgtgccccagaggtgctcctggagcagggcgccaggggggagaccgatggcccttggtggaagctgaaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccccgactccgccagtcgcccctcgcactggacaccttctaaaaaaactacaaggaaaatcaagattagccaaactccatggttggtggtctgtgctcagtgctgatcaccaagtggaaactcctggaatctcacggctggggctcctctcccagactccctttgtgtgttcagacgtctgctaaatcgagcaccggtcgtgtatatacgtctgatggcgcgagggaggcgatacg

SEQ ID NO: 793581 - DNA, 700 bp, Homo sapiens
  misc_feature: 69598.44.55.E11.1.pb.heavy.1.raw 69598
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggc

SEQ ID NO: 793582 - DNA, 715 bp, Homo sapiens
  misc_feature: 69607.44.85.H08.1.pb.heavy.1.raw 69607
ctatgcgccttgccagcccgctcagacagtatataggaagtagtccttgaccaggcagcccaggccgctgtgccccagaggtgctcttgaggagggtgccaggggaagaccgatgggcccttggtggaggctgaggagacggtgaccgtggtcccttggccccagacgtccataccgtagtagtagtccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacagagagtctcaggacctcccaggctggaccacgcctccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccggtcgtgtatatactgtctgatggcgcgagggaggcgatacg

SEQ ID NO: 793583 - DNA, 690 bp, Homo sapiens
  misc_feature: 69608.UNK.UNK.UNK.pb.heavy.1.raw 69608
ctatgcgccttgccagcccgctcagacgcagtatataggaagtagtccttgacccaggcagcccagggccgctgtgctctcggaggtgctctggagcagggcgccagggggaagaccgatggccctggtggaggctggagagacggtgaccagggctccctggccccagtagaacgatgggctcgtacaataatagagagccgagtcctcggctcctcaatatgttcatttgtagatacacggtgttctttggaattgtctctggagacggagaatcggccccttcacggagtttccatagtattctttacttccatcagaccagatgactgccacccactccagccccttgcctggagcctggcggacccagtgcatggcagagtcacctgaaactgagtcggacgcaacacaggagagtctcagggacgtcccaggctggaccacgcctcccccagactccaccagctgaacctgacactggacacctcttaaaagagcaacgaggaaaacccagctcagcccaaactccatggtggagtcctctgtgttcagtgctgatcaccgaatggaaacaccgccggacttctagtgctggggctcctctcccaggccccctttccttactgactcactaaatcgagcacccggtcgtgtattactgtctgatggcgcgagggaggcgatacg

SEQ ID NO: 793584 - DNA, 683 bp, Homo sapiens
  misc_feature: 69615.44.53.E09.1.pb.heavy.1.raw 69615
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcacccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793585 - DNA, 572 bp, Homo sapiens
  misc_feature: 69616.44.78.H01.1.pb.heavy.1.raw 69616
ctatgcgccttgccagcccgctcagacagtattaggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 793586 - DNA, 685 bp, Homo sapiens
  misc_feature: 69617.44.35.D02.1.pb.heavy.1.raw 69617
ctatgcgccttgccaaacgaccgcccagacagtatataggaagtagtccttgaccaggtcagcccagggccgctgtggccgcaagagtgctcttggagaggtgccaggggggaagaccgatgggcccttggtggaggctgaggagacggtgaccagggttcccgggcccagggtcgagccagttcgcccccgttctctactgtatcgataggaatctctcgcacaataatatacggccgtgtccgcggcggtcacagaagtcaatttcagggagaactggttcttggacctgtctagttgacatggtgactcgactcttgagggcgggggttgtagttggtgctgccactgttatagatgcgcccaatccactccagtccctccggcgactgccgcagccaactccaataataactactgatgtaaccaccagagacattgcaggtgaggggacagggtctccgaaggcttcacccgtcctgggcccgactcctgcagctgcaccttcggacacgcccatctgggaggtggccaccaggaggaggaagaaccacaggtgttttcatgttcttgtgcaggaggccatggagtctccagaaagtatccccaaacccaactatcgtgtgctaaatcgagcaccggtcgtggtatatactggtctgatgcgcgagggaggcgattaccg

SEQ ID NO: 793587 - DNA, 660 bp, Homo sapiens
  misc_feature: 69632.44.12.B01.1.pb.heavy.1.raw 69632
ctatgcgccttgccagcccgctcagacagtatataggaagtagtccttgaccaggcagcccagggccgctgtgcccccagaggtgctcttggaggagggtgccagggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacaggtctccgaaggcttcaccagtcctggcccgactcctgcagctgcagctgggacaggacccatctgggagccgccaccagcaggaggaagaaccacaggtgcttcatgttcttgcacaggaggtccatgactctcagaagcccccgcggaatctacactactaaatcgagcaccggtcgtgtatatactgtctgatggcgcgagggaggcgatacg

SEQ ID NO: 793588 - DNA, 659 bp, Homo sapiens
  misc_feature: 69637.44.12.B01.1.pb.heavy.1.raw 69637
cgtatcgcctccctcgcgccatcagacagtatatacacgaccggtgctcgatttagtagtgtagattccgcggggggctttctgagagtctggactctggcacatgaaagcacctgtgttcttcctcctgctggtggcgggctcccagatggggtctgtcccagctgcagctgcaggagtcggcccaggactggtgaagccttcgagagcccctgtccctcacctgcactgtctctggtggctccatcagcagtagtagttactactgggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccactactttgaccactgggggccagggaaccctggtcaccgtctcctcagcctccaccaagggcccatcggtcttccccctggcaccctcctccaagagcacctctgggggcacagcggccctggctgcctggtcaaggactacttcctatatactgtctgagcgggctggcaaggcgcatag

SEQ ID NO: 793589 - DNA, 706 bp, Homo sapiens
  misc_feature: 69644.44.55.E11.1.pb.heavy.1.raw 69644
ctatgcgccttgccagcccgctcagacagtatataggaagtagtcccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacacctttaaaagtccaacaaggagaacccagctcagccaaaactccatggtgagtcctctgtgttcagtgctgatcaccgaatggaaacacctcggaattcccagtgctgggctcctctcccccccaaacccaacgtgcgagtgctaaatcgagcaccggtcgtgtatatactgtctgatggcgcgagggaggcgatacg

SEQ ID NO: 793590 - DNA, 607 bp, Homo sapiens
  misc_feature: 69654.UNK.UNK.UNK.pb.heavy.1.raw 69654
aggctgggcaggctatgcaccctggtccaggtcaaaagctgcggaacccgctaagcggccatcttggccactaggggtcccgcagattcatattgtcgtctagcatgcacaatgctgcaacccagcttgcaatgcccacagcaagcggccaatctttacgccacgttgaattgtttattacctgtgactggctatggcttgcaaacgccactcgtaaaactagtactttgcggtttaggggaagttagacaaaccccattactccacttcccggaagttcaactcattccaacacgaaataaagtaaactcaacaccccaagcaggctatgtggggggtgataggggtggattctatttcctatccatcccctaggatctcattaagttactagcgagttaaatgtctgtagcgatcccgtcagtccctatcgcgcgcatcaagacctggtggtgagcgtgccagtagatcatcgataagctgcgagttaggtcatcccagaccgcatctggcgcctaaacgttcagtggtagctaaggcgtccaccttcgactgtctaaaggcaatatgtcgtccttagctccaagtccctagcaagcgtgtcggg

SEQ ID NO: 793591 - DNA, 691 bp, Homo sapiens
  misc_feature: 69680.UNK.UNK.UNK.pb.heavy.1.raw 69680
ctatgcgccttgccagccgctcagacagtatataggaagtagtccttgacaggcagccagggccgctgtgctctcggagtggccctggagcagggcgccaggggaagaccgatgggcccttgggtaggccgaggagacggtgaccagggttccctggcccaggcgtcgaatgaaccgattttggaaaaaagatgtctcgcacaaaaatacacggccgtgtcctgagtctcaggctgttcatttgaagagacactgtgttctcggaattgtctctggagatggtgaatcggccctcaacggaatcaccgtagacttgatttcctccatgaatgacacacctgccacccactccagcccctcgcctggagcctggcggaccactgcatattccaattatcgaaggtgaatccagaggctgcacagaggagtctcagggacccccctactgggccacgcctccccagactccacgaattgcacctgacacatgacacctcttaaagggcaacgaggaaaaacccagctcagcccaaaaactcccatgagtcctctgtgttcagtgatgatcaccgagtggaaacaccggcgacttccagtgctgggctcgtctcccagccccaacccttcgatcgcgtctaaaatcgagcaccgttcgtgtatatactgtcgatggcgcgagggaggcgatacg

SEQ ID NO: 793592 - DNA, 693 bp, Homo sapiens
  misc_feature: 69777.UNK.UNK.UNK.pb.heavy.1.raw 69777
tatcgcctccctcgcgccatcagacagtatatacacgaccgggtgctcgattagacgcgatcgaagggttggggctgggagacgagccagcactggaagtcgccggtgttttcactcggtgatcatcactgacacagagagctcaccatggagtttgggctgagctgcggttttcctcgttgccctcttaagaggtgtcatgtgtcaggtgcaattcgtggagtctggggaggcgtgccagtggccccgtgggggtcctgagactctcctgtgcagcgctctggattcacgcttcggataattggaatatgcgtggtcgccagctccaggcgagggctggagtgggtggcaggtgtgtcatttcatggaggaatcaagtctacggtgattccgttgagggcgattcaccatctccagagacaattccgagaacacagtgtctcttcaaatgaacagcctgagacgctcaggacacggcgtgtatttttgtgcgagactatctgtttccaaaaatcgttcattcgacgcctggggccagggaaccctggtcaccgtctcctcggcctccaccaagggccatcgtcttcccctggcgcctgctcagaggcacctccgagagcacagcggcctgggctgcctggtcaaggaactactccgtatatactgtctgagcgggctggcaagcgcgcatag

SEQ ID NO: 793593 - DNA, 672 bp, Homo sapiens
  misc_feature: 69779.44.73.G07.1.pb.heavy.1.raw 69779
cgtatcgcctcctcgcgcgccatcagacagtatatacacgaccggtgctcgatttagctctacgctcagggccgctgtgctctcggcgtgtttccattcggtgatcagcactgaacacagagactcaccatggagtttggctgagcccgggtttcctcgttactcttttaagaggtgtccagtgtcaggtgcacctggtgagtctggggaggcgtggtccagcctgggaggtcctgagactctcctgtgaagcctctggatttgtttcagtagttctggcatgcactggtcgccaggctccaggcaagggccggagtggttggcagttatagcatatgatggaaactctagatattatgcagactccgtgaagggcccgatcaccatctccagagacaattcccggaacactctgtacctggaaatgatcagcctgagaggcgaggactcggctctgtattactgtgcgagatcggaagtggcagcagctattatcggcgtttcacggggccagggacactggtcaccgtccctcagcctccaccaaggcccatcggtcttccccctgcgcgccctgctccaggagcacctccgagagccacagcggccctgggctgcctggtcaaggactcttcctatatactgtctgagcgggctggcaaggccgcatag

SEQ ID NO: 793594 - DNA, 554 bp, Homo sapiens
  misc_feature: 69791.44.43.D10.1.pb.heavy.1.raw 69791
cgtatcgcctccctcgcgcccatcagacagtatatacacgaccggtgctcgatttagactagcagtaaggggctgaggtgaagaagcctggggcctccagtgaaggtctcctgcaaggcttctggatacacttcaccaattatgatatcaactgggtgcgacaggccactgacaagggcttgagtggatgggatggatgaacccctaacagtggtaacacaggctatgcacagaagttccagggcagagtcaccatgaccaggaacacctccaaataacacagcctacatggagctgagcagcctgagatctgaggacacggccgtgtattactgtgcgagatcccgaaagtatagcagctcgtcgggaggtggttcgacccctggggccagggaaccctggtcaccgtctcctcagcttccacaagggcccatcggtcttccccctggcgccctgccccaggagcacctctggggggcacagcggccctgggctggcctggtcaaggactacttcctatataccctgtctgagccggctggcaaggcgcatag

SEQ ID NO: 793595 - DNA, 617 bp, Homo sapiens
  misc_feature: 69792.UNK.UNK.UNK.pb.heavy.1.raw 69792
cgtatcgcctccctcgcgccatcagacagtatatacacgacggtgctcgatttagtacacgtgattagggattggggcaggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaaggcccatcggtcttccccctggcgcctgctccaggagcacctctgggggcacagcggccctgggctgcctggtcaaggactacttcctatatactgtctgagcgggctggcaaggcgcatag

SEQ ID NO: 793596 - DNA, 564 bp, Homo sapiens
  misc_feature: 69793.UNK.UNK.UNK.pb.heavy.1.raw 69793
ctatgcgccttgcagccgctcagacagtatataggaagtagtcttgaccaggcagccaggccgctgtgctctcggaggtgctcctggagcagggcgccaggggaagaccgatgggcccttggtggaggctgaggagacggtgaccaggttccctgcccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcaccagttaatatcataattgatgaacgtgtatccagaagccgtgcaggagactgtcactgaggccccaggcttcttcacctcagcgcagcgtggtgaccgtgacctccagcaacttcggcacccaaaccaaactactcacactaaatcgagcaccgggtcgtgtatatactgtctgatggcgcgagggaggcgaacg

SEQ ID NO: 793597 - DNA, 621 bp, Homo sapiens
  misc_feature: 69807.44.23.C01.1.pb.heavy.1.raw 69807
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggagggtcagtttcagggagaagcggttcatggacgtgtccctcgaaatggtgagacgactcttgaggacggagagtagtacgtcgccccagtataatggatgtcaccaatccactccattcccctccctgggggctgccggatccagccccaagaatgatcagaactgatggaaactccagagacagtgcagatgagagacagggttccccgaaggcctcaccagtcctgggcccgactcctgcagctgcacctgggacaggacccatctgggagctgccaccagcaggaggaaaaaccacaggtgttcaccctgcccaatccctaatcacgtgtactaaatcgagcaccggtcgtgtatatactgtctgatggcgcgagggaggcgatacg

SEQ ID NO: 793598 - DNA, 705 bp, Homo sapiens
  misc_feature: 69816.44.55.E11.1.pb.heavy.1.raw 69816
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagtttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagaacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 793599 - DNA, 698 bp, Homo sapiens
  misc_feature: 69817.44.56.F01.1.pb.heavy.1.raw 69817
ctatgcgccttgccagccgctcagacagtatataggaagtagtccttgaccaggcagcccaggccgctgtgccccagaggtgctcctggagcagggcgccaggggaagaccgatgggcccttggtggaagctgaagagacggtgaccattgtcccctggcccaatatcaaatgcatcgacgtccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaagtgatccactcaagccccttccctggagcctgacggacccaggccaagtgataatcactaagactgaatcctgagactacacaggagagtctcagagaccgcctgctgtgcaagccccccccgactccgccagtcgcccctcgcactggacaccttctaaaaaactacaaggaaaatcaagattagcccaaactccatggttggtggtctgtgctcagtgctgatcaccaagtggaaactcctggaatctcacggctgggctcctctccagagctccctttgtgtgttcagacgtctgctaaatcgagcaccggtcgtgtatatactgtctgatggcgcgagggaggcgatacg

SEQ ID NO: 793600 - DNA, 702 bp, Homo sapiens
  misc_feature: 69830.44.36.D03.1.pb.heavy.1.raw 69830
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggacaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793601 - DNA, 628 bp, Homo sapiens
  misc_feature: 69839.44.86.H09.1.pb.heavy.1.raw 69839
cgtatcgcctcccctcgcgccatcagacagtatatacacgaccggtgctcgatttagtgctatagacttgggtttggggatgctttctgagagtcaaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccgcagccccagggaggggaatggagtggattggtgacatccattatactggggcgacgtactactctccgtccctcaagagtcgtctcaccattcgagggaccacgtccatgaaccgcttctccctggaaactgacctccgtgaccgccgcggacacggccgtttattctgtgcgaggcgagactggtctttcatctatggggccgtgggcaccctggtcactgtccctcagcttccaccaagggccccatcggtcttccccctggcgccctgctccaggagcacctctggggcacagcggccctgggctgcctggtcaaggactacttcctatatact

SEQ ID NO: 793602 - DNA, 618 bp, Homo sapiens
  misc_feature: 69855.44.23.C01.1.pb.heavy.1.raw 69855
cgtatcgcctccctcgcgccatcagacagtatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatgggggccgtggcaccctggtcactgtctcctcagcttccaccaagggcccatcggtcttccccctggcgccctgctccaggagcacctctgggggcacagcggccctggctgcctggtcaaggactacttcctatatactgtctgagcgggctggcaaggcgcatag

SEQ ID NO: 793603 - DNA, 696 bp, Homo sapiens
  misc_feature: 69857.44.74.G08.1.pb.heavy.1.raw 69857
cgtatcgcctccctcgcgccatcagacagtatatacacgaccggtgctcgatttagtagctctatcaggggagcatcacataacaaccacattcctcctctaaaagaagcccctgggagcacagctcatcaccatggactggacctggaggttcctctttgtggtggcagcagcaacaggtgtccagtccctggtgcaaaactggtgcagtctgggactagaatgccgcaaccttggtcctcggtgaccctttcctgcacaggcctctggaagtactaccagttccactacttataccatcaactgggtgcgccaggcccctggacaagggcttgagtggatgggtggaatcatccctcttttggctcactcacctacgcacgagacttccggggcagaattacgattaccggcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 793604 - DNA, 702 bp, Homo sapiens
  misc_feature: 69861.44.36.D03.1.pb.heavy.1.raw 69861
cgtatcgcctccctcgcgccatcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793605 - DNA, 708 bp, Homo sapiens
  misc_feature: 69875.44.55.E11.1.pb.heavy.1.raw 69875
cgtatcgcctcccctcgcggccatcagacagtatatatacacgaccggtgctcgattttagcactcgcacgttgggtttggggagaggagagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtccagagactctcctgtgcagcctctggctcaccgtcagccagcaactacatgagttgggtccgccaggctccaggaaggggctggagtgggtctcagtcatttatactggtggatttcacatactacgcagaactccgtgaagggccgattcaccatctccaggacaattccaggaacacggtttatcttcaaatgaacaacctgagaggcgacgacacggccgtctattactgtgcgagacaagtcggcgctcggagtggttattattcgtttgacttctggggccagggaaccctggtcacgtcgcctccgcctccaccaagggcccatcggtcttccccctggcacccctctccaagagcacctctgggggcacagcggcctgggctgcctggtcaaggactacttcctatatactgtctgagcgggctggcaaggcgcatag

SEQ ID NO: 793606 - DNA, 685 bp, Homo sapiens
  misc_feature: 69885.44.71.G05.1.pb.heavy.1.raw 69885
cgtatcgcctcctcgcgccatcagacagtatatacacgaccggtgctcgatttagtgtcgtcgcaagagagaggagccccagccgtgagattccaggagtttcacttggtgatcagcactgagcacagaccaccaaccatggagtttgggctatcttgattttccttgtagtttttttagaaggtgtccagtgcgagggcgactggcggagtcgggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagaccgacgacacaggcgtctattactgcgccaggcgatcctggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 793607 - DNA, 681 bp, Homo sapiens
  misc_feature: 69886.44.45.E01.1.pb.heavy.1.raw 69886
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcacccatggagtttgggctgagctgggttttcctcgttgctcttttaagaggtgtccagtgtcaggttcagctggtggagtctggggggaggcgtggtccagcctgggacgtccctgagactctcctgtgttgcgtccgactccagtttcaggactctgccatgcactggggtccgccaggctccaggcaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctcctattattgtacgagcccatcgttctactgggccagggagccctggtcaccgtctcctcagcctcacccaagggcccatcggtcttcccctggcgccctgctccaggagcacctccgagagcacagcggccctgggctgcctggtcaaggactacttcctatatactgtctgaggcggctggcaaggcgcatag

SEQ ID NO: 793608 - DNA, 529 bp, Homo sapiens
  misc_feature: 69887.44.27.C05.1.pb.heavy.1.raw 69887
cgtatcgcctccctcgcgcatcagacagtatatacacgaccggtgctcgattagacgcgatcgaaggtttggaggcgtggccccagtagggggtccctgagactctcctgtgcagcctctggattcaccttcgatattggaatatgcagtgggtccgccaggctcaggcgagggctggagtggggtggcaggtgtgtcatttcatggaggaaatcaagtctacggtattccgttgaggccgattcaccatctccagagacaattccgagaacacagtgtctcttcaaatgaacagcctgagacctcaggacacgccgtgtattttgtggcgagactatctgtttccaaatcggttcattcgacgcctggggccagggaaccctgtcacgtctcctcggcctccaccaaggcccatcggtcttccccctggcgccctgctccaggagcacctccgagagcacagcggccctgggctgcctggtcaggactacttcctatatactgtctgagcgggctgcaaggcgcatag

SEQ ID NO: 793609 - DNA, 605 bp, Homo sapiens
  misc_feature: 69913.44.36.D03.1.pb.heavy.1.raw 69913
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacagcacatattactgtgcacgggtaatgcgggaaagaaacagctggtttctgtattataagtcttaccatctggacgtctggggcaaagggacacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793610 - DNA, 666 bp, Homo sapiens
  misc_feature: 69949.44.45.E01.1.pb.heavy.1.raw 69949
cgtatcgctcctcgcgccatcagacagtatatacacgaccggtgctcgattttagtgagtcagtaagggaaggggctgggagaggagcccagcactagaagtcggcggtgttttccattcggtgatcagccactgaacacagaggactcaccatggagtttgggctgagctggtttcctcgtgctcttttaagaggtgtccagtgtcagttcagctggtggagtctggggaggcgtggtccagcctgggacgtccctgagactctcctgtgttgcgtccggactcagtttcagtgactctgccatgccactgggtccgcaggctccagcaaggggctggagtgggtgggcagtcatctggtctgatggaagtaaagaatactatggaaactccgtgaagggccgattctccgtctccagagcaattccagaacaccgtgtaatctacaaatgaacatttgagagcgagactcggctctctatattgtacgagcccatcgttctactggggccagggagccctggtcaccgtctcctcagcctcccaagggcccattcggtcttccctgcgccctgctccaggagcacctccgagagcacagcggcctgggctgcctggtcaaggactcttcctatatactgtctgagcgggctggcaggcgcatag

SEQ ID NO: 793611 - DNA, 672 bp, Homo sapiens
  misc_feature: 69986.UNK.UNK.UNK.pb.heavy.1.raw 69986
cgtatcgcctccctcgcgccatcagacagtatatacacgacggtgctcgatttagtgagtcagtaagggaaagggctgggagaggagcccagcactagaagtcggcggtgtttccattcggtgatcagcactgaacacagaggactcaccatggagtttggctgagctgggtttcctcgttgctcttttaagaggtgtccagtgtcaggttcagctggtggagtctggggaggcgtgtccagcctgggacgtccctgaactctcctgtgttgcgtccggactcagtttcagtgactctgccatgcactgggtccgccaggctccaggcaaggggctggagtgggtgcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccattggtcttcccctggcgccctgctccaggagcacctccgagagcacagcggccctggctgcctggtcaaggactacttcctatatactgtctgagcggctggcaaggcgcatag

SEQ ID NO: 793612 - DNA, 712 bp, Homo sapiens
  misc_feature: 69999.UNK.UNK.UNK.pb.heavy.1.raw 69999
ctatggcgccttgccagcccgctcagacagtatataggatagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaacgtgttcctggaattgtccctggagatggtgaatcgggcccttcacggagtctgcgtagtatgtgaaatcacagtataaatgactgagacccactccagcccccttccctggagcctggcggacccaactcatgtagttgctgctgacggtgagccagaggctgcacaggagagtctctgggaccccccaggctggactaagccccctccagacccatcagccgcacctccactggaccccttttaaaagtccaacaaggagaacccagctcagccaaaactccatgggggagtcctctgtgttcagtgctgatcaccgaatggaaacagcctcggaatcccagtgctgggctcctctccccccaaacccaacgtgcgagtgcaaatcggagccaccgggtcggataggatagaactgggggatggcgcgagggaggcgatacg

SEQ ID NO: 793613 - DNA, 678 bp, Homo sapiens
  misc_feature: 70037.44.23.C01.1.pb.heavy.1.raw 70037
ctatgcgccttgccagcccgctcagacagtatataggaagtagtcccttgaccaggcagcccagggccgctgtgcccccagaggtggctcctggagcagggcgccagggggaagaccgatgggcccttgggtggaagctgaggagacagtgaccaggggtgcccacgggccccatagattgaaaagaccagtctcgcctcgcacagaaataaacgggccgttgtccgcggcgggtcacggaggtcagtttcagggagaagcggttcatgggacggtgtccctcgaaatggtgagacggactcttgagggacggagagtagtacgtcgccccaggtataatggatgtcaccaatccactccattcccctccctgggggctgccggatccagccccaagaatgatcagaactgatggaaactccagagacagtggcagatgaagagacaggggttcccgaaggcctcaccagtccctggggcccgactccttgcagctgcacctggggacaaggacccatctgggagcctgccaccagcaggaggaaaaaaccacaggtgcttcaatgttcttgggcacaggaggtccttgactctcaggaaagcccccaatccctaatcacgtgtactaaatcgagcaccggtcgtgtatatactgtctgatggcgcgagggaggcgaa

SEQ ID NO: 793614 - DNA, 688 bp, Homo sapiens
  misc_feature: 70040.44.67.G01.1.pb.heavy.1.raw 70040
ccagcccgctcagacagtatataggaagtagtccttgaccaggcagccagggccgctgtgcccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccacaaggagaacccagctcagccaaaactccatggtgagtcctctgtgttcagtgctgatcaccgaatggaaacacctcggaatcccagtgctgggctcctctccccccaaacccaatatgtatactctaatcgagcaccggtcgtgtatatactgtctgatggcgcgagggaggcgatacg

SEQ ID NO: 793615 - DNA, 604 bp, Homo sapiens
  misc_feature: 70046.UNK.UNK.UNK.pb.heavy.1.raw 70046
ctatgcgccttgccagcccgctcagacagtatataggaagtagtccttgaccaggcagccagggccgctgtgcccccagaggtgctcctggagcagggcgccaggggaagaccgatgggcccttggtggaagctgaggagacggtgaccgtggtccctttgtcccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcacggtcgtgtatatactgtctgatggcgcgaggaggcgatacg

SEQ ID NO: 793616 - DNA, 706 bp, Homo sapiens
  misc_feature: 70055.44.36.D03.1.pb.heavy.1.raw 70055
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctgggccccagtggacagttcctgatataaacacaacacaataatacatggccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgcctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793617 - DNA, 711 bp, Homo sapiens
  misc_feature: 70060.44.36.D03.1.pb.heavy.1.raw 70060
cgtatcgcctccctcgcggccatcagacagtatatacacgaccggtgctcgatttagctgcgtcacgatctctcttgggggagagcggagcccccagccccagaattcccaggtgttttcattttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctctcagggaaggggctggagtggcttggccgcagtaaaaacaaaagttgccagctttatcacagagtacgccgcgtctggtgaaagccagattcaccctctcaagagatgacttcaagaactcattgattctgcgaatgactaacctgaaaaccggaggacacgggcatgtattattgtgttgtgtttatatcaggaactgtccactggggccaggggaaaccctggtcaccgtctcctccagcctccaccaagggccccatcggtctttccctgggcgccctgctccaggagcaccttccgagagcacagcggccctgggctgcctggtcaaggactacttcctatatactgtctgagcgggctggcaaggcgcatag

SEQ ID NO: 793618 - DNA, 682 bp, Homo sapiens; identical to SEQ ID NO: 790991
  misc_feature: 70068.44.45.E01.1.pb.heavy.1.raw 70068

SEQ ID NO: 793619 - DNA, 710 bp, Homo sapiens
  misc_feature: 70069.44.36.D03.1.pb.heavy.1.raw 70069
ctatgcggccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggtttcaggttagtcattcgcagaatcaatgagttcttgaagtcatctcttgagagggtgaaatctggctttcacagacgcggcgtactctgtgataaagctgggcaactttgtttttactgcggcccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggcctccgctctcagagctccccaagagagatcgtgacgcagctaaatcgagcaccggtcgtgtatataactgtctgatggcgcgagggaggcgatacg

SEQ ID NO: 793620 - DNA, 722 bp, Homo sapiens
  misc_feature: 70075.44.85.H08.1.pb.heavy.1.raw 70075
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 793621 - DNA, 711 bp, Homo sapiens
  misc_feature: 70077.44.27.C05.1.pb.heavy.1.raw 70077
ctatgcgccttgccagcccgctcagaccagtatataggaagtagtccttgaccaggcagcccagggccgctgtgctctcggaggtgctcctggagcagggcgccaggggaagaccgatgggggcccttggtggaggccgaggagacggtgacccagagggttccctggccccaggcgtcgagatgaaccgattttggaaacagatagtctcgcaaaaaatacacggccgtgtcctgaggtcttcaggctgttcatttgaagagacactgtgttctcggaattgtctcctggagatggtgaaatcggccctcaacggaatcaccgtagacttgatttcctccatgaaatgacacacctgccacccactccagcccctcgcctggagcctggcggacccactgcatattccaattatcgaaggtgaatccagaggctgcacaggaggagtccgggaccccctactggggccacgcctccccccagactccacgaattgcacctgacacatgacacctcttaagagggcaacgaggaaaacccagctcagcccaaactccatggtgagtctctgtgttcagtgatgatcaccgagtggaaacaccggcgacttcagtgctggctcgtctcccaggccccaaacccttcgatcgcgtctaaatcgagcaccggtcgtgtatatactgtctgatgcgcgcggagggaggcgatacg

SEQ ID NO: 793622 - DNA, 730 bp, Homo sapiens
  misc_feature: 70083.44.36.D03.1.pb.heavy.1.raw 70083
cgtatcgcctccctcggcgccatcagacaggtatatacacgaccggtgctcgatttagctgcgtcacgatcttctcttggggagctcttgagagccgaggccccaggcccaagaattccaggtgttttcatttggtgatcagcactgaacacaaggactcaccatggagttcgggctgagctgggttttccttgttgttattttacaaggtgtccagagtgaagtgcagttggtgggagtcgggggagacttggtccagcctggagggtcccctgagactcttcctggtgtcgcctctggattcaccatcagtgaccactatatggactgggtccgccaggccagggaagggcgggctggagtggcttggccgcagtaaaaacaagagttgccagctttatcacagagtacgcccgcgtcttggtgaaagcccagattcacccttctcaagagatgacttcaagaactcattgattctgtgaatgactaacctgaaaaaccgaggacacgggcatgtattattgtgttgtgtttatatcaggaactgtccactgggggccagggaaccctggtcaccgtctcctcagcctccaccaagggcccatcggtcttccccctggcgcgcctgctccaggagggcaccctccgaagagcacagcggccctggggctgcctggtcaaggactactcctatatactgtctgagcgggctggcaaagggccgccatag

SEQ ID NO: 793623 - DNA, 652 bp, Homo sapiens
  misc_feature: 70089.44.23.C01.1.pb.heavy.1.raw 70089
cgtatcgcctccctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793624 - DNA, 608 bp, Homo sapiens
  misc_feature: 70105.44.78.H01.1.pb.heavy.1.raw 70105
ctatgcgcccttgccagcccgctccagacagtatataggaagtagtccttgaccaggcagcccagggccgctgtgctctcggaggtggctcctggagcagggcgccagggggaagaccgatgggcccttggtggaggctgaggagacggtgacccagggttccctggccccacaagtcaagccaggtgctggtggctctcgcacagaaatacacgggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagccggccctgtcgcacccagtttaatatcataattgatgaaaaacgtgttatccagagccgtgcaggaggactgtcactggaggcccccaggcttcttcacctcagcccccagactgccaccagctgtacctggagtggaccgtcagtcttcctcttcccccaaaccccaaactactcacactaaatcgagcaccggtcgtgtatatactggtctgatggcggcgagggaggcgatacg

SEQ ID NO: 793625 - DNA, 698 bp, Homo sapiens
  misc_feature: 70108.UNK.UNK.UNK.pb.heavy.1.raw 70108
cgtatcgcctccctcgcgccatcagacagtatatacacgacggtgctcgatttagtgtcgtcgcaagagagaggagccccagccgtgagattcccaggagtttccacttggtgatcagcactgagcaccagaccaccaaccatggagtttggggctaatcttgattttccttgtagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacggccgcgtctgtgaagggagattcaccgtctcaagggatgactccaacagtgttggccatttacaaatgagcaacctggagaccccgacgacacaggcgtctattactgcgccaggcgatcctgggacgtcgatgcatttgatatttgggccaggggacaatggtcaccgtctcttcagcttccaccaagggcccatcggtcttccccctggcgccctgctccaggagcacctctggggggcacagcggcctgggctgcgctggtcaaggactacttcctatatactgtctgagcgggctggcaaggcgcatag

SEQ ID NO: 793626 - DNA, 682 bp, Homo sapiens
  misc_feature: 70109.UNK.UNK.UNK.pb.heavy.1.raw 70109
ctatgcgcttgccagcccgctcagacagtatataggaagtagtcttgaccaggcagcccagggccgctgtgctctcggaggtgctctggagcagggcgccagggggagaccgatggccttggtggaggctgaggagacggtgaccagggttccctggcccagtggacagttcctgatataaacacaacacaataatacatgcccgtgtcctcggttttcaggttagtcattcgcagaatcaatgagttctgaagtcatctcttgagagggtgaatctggctttcacagacgcggcgtactctgtgataaagctggcaacttgttttactgcggcaagccactcagccccttcctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaacccgctcagcccgaactccatggtgagtcctctgtttcagtgctgatcaccaaatgaaacacctggaattctgggctggggctccgctctcagagctcccaagagagatcgtgacgcagctaaatcgagcaccgtcgtgtataactgtctgaggcgcgagggaggcgatacg

SEQ ID NO: 793627 - DNA, 677 bp, Homo sapiens
  misc_feature: 70110.UNK.UNK.UNK.pb.heavy.1.raw 70110
ctatgcgccttgccagcccgctcagacagtatataggaagtagtccttgaccaggcagcccagggccgctgtgccccagaggtgctcttggaggagggtgccaggggaagaccgatgggcccttggtggaggctgaggagacggtgaccagggttccctggccccaggggtcgagccagttcgccccccgtctctactgtatcgataggaatctctcgcacaataatatacggccgtgtccgcggcgggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgagggacagggtctccgaaggcttcaccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgagccaccggtcgtgtatatactgtctgatggcgcgagggaggcgatacg

SEQ ID NO: 793628 - DNA, 712 bp, Homo sapiens
  misc_feature: 70122.44.56.F01.1.pb.heavy.1.raw 70122
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctatcttgattttccttgtagtttttttagaaggtgtccagtgcgagggcgactggcggagtcgggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 793629 - DNA, 617 bp, Homo sapiens
  misc_feature: 70149.44.38.D05.1.pb.heavy.1.raw 70149
ctatgcgccttgccagcccgctcagacagtatataggaagtagtccttgaccaggcagcccagggccgctgtgcccccagaggtgctcctggagcagggcgccagggggaagaccgatgggccctggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagcccttccctggagcttggcggacccagtgcatccagtagctactgaaggtgaatccagaggctgcacaggagagtctcagggaccccccaggctgaactaagcctcccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 793630 - DNA, 699 bp, Homo sapiens
  misc_feature: 70171.44.36.D03.1.pb.heavy.1.raw 70171
ctatgcgcttgccagcccgtcagacagtatataggaagtagtccttgaccaggcagcccagggccgctgtgctctcggaggtgctcctggagcagggcgccagggggaagaccgatggcccttggtggaggctgaggagacggtgaccaggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctgggctccgctctcagagctccccaagagagatcgtgacgcagctaaatcgagcaccggtcgtgtatatactgtctgatggcgcgaggaggcgatacg

SEQ ID NO: 793631 - DNA, 616 bp, Homo sapiens
  misc_feature: 70177.44.23.C01.1.pb.heavy.1.raw 70177
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcaggagaagcgttcatgacgtgtcctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgagggaggcgatacg

SEQ ID NO: 793632 - DNA, 606 bp, Homo sapiens
  misc_feature: 70189.UNK.UNK.UNK.pb.heavy.1.raw 70189
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgccacgctcaaccaaccaggtcttgatgcgcgcgataggactgacggatcgctacagacatttaactcgctagtaacttaattgagatcctagggggatgggataggaaatagaatccaccctatcaccccccccacatagcctgcttggggtgttgagtttacttttatttcgtgttggaatgagttgaacttccgggaagtggagtaatggtttgtctacttcccctaaccgcaaagtactagttttacgagtggcgttgcaagccatagccagtcacaggtaataaacaattcaacgtggcgtaaagattggccgcttgctgtggcattgcaagctgggtttgcagcattgtgcatgctagacgacaatatgaatctgcgggaccctagtggccaagatggccgctagcgggttccgcagcttttgacctggaccagggtgcatagcctgcccagccttc

SEQ ID NO: 793633 - DNA, 608 bp, Homo sapiens
  misc_feature: 70235.UNK.UNK.UNK.pb.heavy.1.raw 70235
ccgaccacgcttgctagggacttggagctaaggacgaacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggccgtaaagattggccgcttgctgtgggcattgcaagctgggtttgcagcattgtgcatgctagacgacaatatgaatctgcgggacccctagtggccaagatggcgctagcgggttccgcagcttttgacctggaccagggtgcatagcctgcccagcctt

SEQ ID NO: 793634 - DNA, 703 bp, Homo sapiens
  misc_feature: 70236.44.55.E11.1.pb.heavy.1.raw 70236
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagaggactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcgggcgctcggagtggtttatattcgtttgacttctggggccagggaaccctggtcaccgtcgcctccgcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 793635 - DNA, 684 bp, Homo sapiens
  misc_feature: 70278.44.36.D03.1.pb.heavy.1.raw 70278
cgtatcgcctccctcgcgccatcagacagtatattacacgaccggtgctcgatttagctgcgtcacgatctctttggggagctctgagagcggagccccagcccagaattcccaggtgtttcatttggtgatcagcactgaacacagaggactcaccatggagttcggctggcgggttttccttgttgttattttacaaggtgtccagagtgagtgcagttggtgagtccggggagacttggtccagcctggaggtccctgagactctcctggtgcctctgattcaccatcagtgaccactatatggactgggtccgccaggctccaggggaaggggctgagtggcttgccgcagtaaaaacaaagttgccgctttatcacagagtacgccgcgtctgtgaaagccagattcacccctcaagagatgacttcaagaaccgttgattctgcgaatgactaacctgaaaaccgaggacacggcatgtatattgtgttgtgtttatatcaggaactgtccactggggccagggaccctggtcaccgtctcctcagcctcaccaagggcccatcggtcttcccctggcggcccctgctccaggagcacctccgagagcacagcggcctgggctgcctggtcaaggactacttcctatatactgtctgagcggctggcaaggcgcatag

SEQ ID NO: 793636 - DNA, 588 bp, Homo sapiens
  misc_feature: 70293.44.78.H01.1.pb.heavy.1.raw 70293
cgtatcgcctccctcgcgccatcagacagtatatacacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggccagagttagtatgaccaggagcacctcccaggtacagtctacatggaactgagcagcctgagatctgaggacacggccgtgtatttctgtgcgagagccaccagcacctggcttgacttgtggggccagggaaccctggtcaccgtctcctcagcctccaccaagggccatcgtcttcccctggcgccctgctccaggagcacctccgagagcacagcggccctgggctgcctggtcaaggactacttcctatatactgtctgagcgggctggcaaggcgcatag

SEQ ID NO: 793637 - DNA, 546 bp, Homo sapiens
  misc_feature: 70295.44.38.D05.1.pb.heavy.1.raw 70295
ctatgcgccttgccagccccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactatcagatactaaatcgagcaccggtcgtgtatatactgtctgatggcgcgagggaggcgatacg

SEQ ID NO: 793638 - DNA, 648 bp, Homo sapiens
  misc_feature: 70318.44.86.H09.1.pb.heavy.1.raw 70318
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcggaaccctgtctctcatctgcactgtctctggagtttccatcagttctgatcattcttgggctggatccggcagcccccagggagggaatggagtggattggtgacatccattatactggggcgacgtactactctccgtccctcaagagtcgtctcaccatttcgagggacacgtccatgaaccgctctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggcctgggctgcctggtcaaggactacttcctatatactgtctgagcgggctggcaaggcgcatag

SEQ ID NO: 793639 - DNA, 620 bp, Homo sapiens
  misc_feature: 70320.UNK.UNK.UNK.pb.heavy.1.raw 70320
cccgacacgcttgctagggacttggagctaaggacgacatattgcctttagaacagtcgaaggtgacgccttagctaccactgaacgtttaggcgccagatgcggtctgggatgacctaactcgcagcttatcgatgatctactgcacgctcaaccaaccagggtcttgatgcgcgcgataggactgacgggatcgctacagacatttaactcgctagtaacttaattgagatcctacggggatgggataggaaatagaatccaccccctatcaccccccccacatagcctgccttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaaacgtggcgtaaagattggccgcttgctgtgggcattgcaaggctgggtttggcaggcattgtgcatgctagacgacaatatgaatctgcgggaccccctagtggccaagatggcccgctagcgggttccgcagcttttgacctggaccagggtgcatagcctgcccagccttc

SEQ ID NO: 793640 - DNA, 713 bp, Homo sapiens
  misc_feature: 70326.44.55.E11.1.pb.heavy.1.raw 70326
ctatgcgccttgccaggcccgctcagaacagtatataggaagtagtccttgaccaggcagcccagggccgctgtgcccccagaggtgctctggaggagggtgccaggggggaagaccgatgggcccttggtggaggcggaggcgaacgggtgaccagggttccctggccccagaagtcaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaaacccaacgtgcgagtgctaaatcgagcaccggtcgtgtatatactgtctgatgggcgcgagggagggcgatacg

SEQ ID NO: 793641 - DNA, 666 bp, Homo sapiens
  misc_feature: 70328.44.81.H04.1.pb.heavy.1.raw 70328
cgtatcgcctccctcgcgccatcagacagtatatacacgaccggtgctcgatttagtagtgtagattcgcgggggctttctgagagtcattgacctcctgcgcaagaacatgaagcacctgtggttcttcctcctgctggtggcggctcccagatgggtcctgtcccagctgcagctgcaggagtcgggccccaggactggtgaagccttcggagaccctgtccctcacctgcactgtctctggtggctccatcagccagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgtgagagtagggcagttcgtcaccaactactttgacccactgggccagggaaccctggtcaccgtctcctcagcctcccaccaaggggccatcggtcttccccctggcaccctcctccaagagcacctctggggcacagcggccctgggctgcctggtcaaggactacttcctatatactgtctgagcgggctggcaaggcgcatag

SEQ ID NO: 793642 - DNA, 661 bp, Homo sapiens
  misc_feature: 70330.44.12.B01.1.pb.heavy.1.raw 70330
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtactgtctgatggcgcgagggaggcgatacg

SEQ ID NO: 793643 - DNA, 725 bp, Homo sapiens
  misc_feature: 70349.UNK.UNK.UNK.pb.heavy.1.raw 70349
ctatgcgccttgccagccccgctcagacagtatataggaagtagtccttgaccaggcagcccagggccgctgtgccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctcccccaaacccaacgagctcactctaaatcgagcaccggtatatactgtctgatggcgcgagggaggcgatacg

SEQ ID NO: 793644 - DNA, 610 bp, Homo sapiens
  misc_feature: 70350.UNK.UNK.UNK.pb.heavy.1.raw 70350
cccgacacgcttgctagggacttggagctaaggacgacatattgcctttagacagtcgaaggtgaccgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793645 - DNA, 693 bp, Homo sapiens
  misc_feature: 70361.UNK.UNK.UNK.pb.heavy.1.raw 70361
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccagggttccctggccccaggggtcgaaccaatttccatgtgtgggactatgagagggactatgaaagttgacgagggctctcgcacagaaatagatggccgtgtcttcagatctcagcctgctcagctccatgtaggctgtactcgtggattcgtccgcggtaatggtgactctgtcctgaaacttctgtgcgtaattcgatgcaccaaagatagggatgatccctcccagccactcaagcccttgtccaggggcctgtcgcacccaaataaaagcatagctgaagaaggtgcctccagaagccttgcaggagaccttcaccgaggacccaggcttcttcacctcagccccagactgcaccagctgcacctgggactggacacctgtagctgctgccaccacaaagaggaaccgccaggtccagtccatggtgatgagctgtgctcccaggggcttctttagaggaggagtgtggttgttatgtgatcaaaatcgagcaccggtcgtgtatatactgtctgatggcgcgagggaggcgatacg

SEQ ID NO: 793646 - DNA, 702 bp, Homo sapiens
  misc_feature: 70384.44.55.E11.1.pb.heavy.1.raw 70384
cgtatcgcctccctcgcgccatcagaccagtatatacacgaccggtgctcgatttagcactcgcacgttgggtttggggagaggagcccagcactgggattccgaggtgtttccattcggtgatcagcactgaacacagaggacttcaccatggagttttggctgagctgggtctccttgttggacttttaaaaggtgtcagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgattttcacatactacgcagactccgtgaagggccgattcaccatctccagggacaattccaggaacacggtttatcttcaaatgaacaacctgagaggcgacgacacggccgtctattactgtgcgagacaagtcggcgctcggagtgttattattcgtttgacttctggggccagggaaccctggtcaccgtcgcctccgcctccaccaagggcccatcggtcttccccctgcaccctcctccaagagcacctctgggggcacagcggccctgggctgcctggtcaaggactacttcctatatactgtctgagcgggctggcaaggcgcatag

SEQ ID NO: 793647 - DNA, 608 bp, Homo sapiens
  misc_feature: 70386.UNK.UNK.UNK.pb.heavy.1.raw 70386
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccaccctatcacccccccacatagcctgcttggggtgttgagtttacttttatttcgtgtttggaatgagttgaacttccgggaagtggagtaatgggttttgtctacttcccctaaccgcaaaagtactagttttacgagtgcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793648 - DNA, 700 bp, Homo sapiens
  misc_feature: 70395.44.56.F01.1.pb.heavy.1.raw 70395
ctatgcgccttggccagcccgctcagacagtatatagggaagtagtccttgaccaggcagcccagggccgctgtgcccagaggtgctcctggagcaggcgccaggggaagaccgatggcccttggtggaagctgagagacgtgaccattgtcccctggcccaaatatcaatgcatcgacgtcccaggatcgcctggcgcagtaatagacgcctgtgtcgtcgggtctcaggttgctcatttgtaaatggccaacacgttggagtcatccccttgagacggtgaatcttcccttacagaccggcggcgtactctttactccaccataagtttcattctgacgaaagtgatccactcaaagcccttcctggagcctgacggaccaggccaagtgataatcactaagactgaatcctgagactacacaggagagtctcagagaccgccctggctgtgccaagcccccccgactccgccagtcgccctcgcactgacaccttctaaaaaaactacaaggaaaatcagattagcccaaactccatggttggtggtctgtgctcagtgctgatcaccaagtggaaactcctgggaatctcacggctggggctcctctcccagagctcccctttgttgtgtttcagacgtctgctaaatcgagcaccggtcgtgtatatactgttgatggcgcgagggagcgatacg

SEQ ID NO: 793649 - DNA, 700 bp, Homo sapiens
  misc_feature: 70406.44.45.E01.1.pb.heavy.1.raw 70406
cgtatcgcctcccctcgcgccatcagacagttatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggtttttcctcgttttgctcttttaaaggtgtccagtgtcaggttcagctggtggagtctgggggaggcgtggtccagccctggggacgtccctgagactctcctggtgttgcgtccggactccagtttcagtgactctgccatgccactgggtccgccaggcccaggcaaggggctggagtgggtggcagtcattctggtctgatggaagtaaagaaactatgggaaaaactgccccgtgaaggccgattctccgtctccagagacaattccaagaacagccgtgtatcacaaatgaacaatttgagagccgaggactcggctctcctattattgtacgagcccatcggtctactggggccagggagcccctggtcaccgtctcctcgcctccaccaaggggcccatcggtcttcccccttggcgccctgctccagagcaccctccgagagcacagcggccctgggctgcctggtcaaggactacttcctatatacttgtctgagcgggctggcaaggcgcatag

SEQ ID NO: 793650 - DNA, 688 bp, Homo sapiens
  misc_feature: 70407.44.36.D03.1.pb.heavy.1.raw 70407
ctatgcgccttgccagcccgctcagacagtatataggaagtagtccttgaccaggcagccagggccgctgtgctctcggaggtgctcctggagcagggcgccaggggaagaccgatgggcccttggtgaggctgaggagacggtgaccagggttcctggcccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataagctggcaactttgtttttactgcggccaagccactccagccccttcctggagcctggcggacccagtccatatagtggtcactgatggtgaatccagaggcgacacaggagagtctcagggaccctccaggctggacaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctccgctctccccaagagagatcgtgacgcagctaaatcgagcaccggtcgtgtatatactgtctgatggcgcgagggaggcgatacg

SEQ ID NO: 793651 - DNA, 696 bp, Homo sapiens
  misc_feature: 70410.44.55.E11.1.pb.heavy.1.raw 70410
ctatgcgccttgccagccgctcagacagtatataggaagtagtcttgacaggcaggcccaggaccgctgtgcccccagaggtgctcttggaggagggtgccagggaagaccgatgggcccttggtggaggcgaggcgaacggtgacagggttccctggccccagaagtcaacgaataataccactcgagcgccgacttgtctcgcacaaagtaaatagacggccgtgtcgtccgcctctcaggttgtcatttgagataaacgtgttcctggaattgtccctggagatggtgaatcggcccttcacggagtctgcgtagtatgtgaaatcacagtataaatgactgagaccactccagccccttcctggagcctggcggacccaactcatgtagttgctgctgacggtgagcccagaggctgcacaggagagtctctggacctcccgcccggccggacctaaagcctcctccagactccatcagccgcacctcacactggacaccttttaaaagtccaacaaggagaaccagctcagccaaaactccatgtgagtctctgtgttcagtgctgatcacgaatggaaacaccttcggaatccagtgctgggctcctctcccccccaaacccaacgtgcgagtgctaaatcgagcaccggtcgtgtatatactgtctgatggcgcgagggaggcgatacg

SEQ ID NO: 793652 - DNA, 690 bp, Homo sapiens
  misc_feature: 70483.44.72.G06.1.pb.heavy.1.raw 70483
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggccttcacagagtccacatagtgtgtctcagttccatctttcttcatgatggccacccactccagccccttccctggagcctggcggacccagttcatccaataactactaaaggtgaatccagaggctgcacaggagagtctcagggaccccccaggctggaccaagcctcccccagactccaccagttgcacctcacactggacaccttctaaaatagcaacaaggaaacccagctcagtcccaattccatggtgagtcctctgtgctcagtgctgatcaccaagtggaaaggccttggagtccagggctaaggctcctctctcccctttcccttgcagtcgtagctaaatcgagcaccggtcgtgtatatactgtctgatggcgcgagggaggcgatacg

SEQ ID NO: 793653 - DNA, 640 bp, Homo sapiens
  misc_feature: 70517.UNK.UNK.UNK.pb.heavy.1.raw 70517
cgtatcgcctcctcgcgccatcagacagtatatacacgaccggtgctccgatttagtacactgattagggattggggctttctgagagtcaaggacctcctgtgcaagaacatgaagcacctgtgtttttcctcctgctggtgcagctcccagatgggtcctgtcccaggtgcagctgcaggagtcggcccaggactggtgaggccttcgggaacctgtctctcatctgcactgtctctggagtttccatcagttctgatcattcttgggctggatccggcagcccccagggagggaatggagtggattggtgacatccattatactggggcgacgtactactctccgtcctcaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaaggcccatcggtcttcccctggcgccctgctccaggagcacctctgggggcacagcggccctgggctgcctggtcaagactacttcctatatactgtctgagcgggctggcaaggcgcatag

SEQ ID NO: 793654 - DNA, 699 bp, Homo sapiens
  misc_feature: 70519.UNK.UNK.UNK.pb.heavy.1.raw 70519
cggctcagacagtatataggaagtagtccttgaccaggcagcccagggccgctgtggctctcggaggtgctcctggagcagggcgccagggggaagaaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacacctgtgttctcggaattgtctctggagatggtgaatcggctcaacggaatcacccgtagacttggatttcctccatgaaatgacacacctgccacccactccagcccctcgcctggagcctggcggacccactgcaatattccaattatcgaaggtgaatccagaggcctgcacaggagagtctcagggacccccctactggggccacgcctcccccagactccacgaattgcacctgacacatgacaccttcttaagagggcaacgaggaaaacccagctcagcccaaactccatggtgagtcctctgtgttcagtgatgatcaccgagtggaaacaccggcgacttccagtgctgggctcgtctcccagggctccccaaacccttcgatcgcgtctaaatcgagcaaccggtcgtgttatatactgtctgatggcgcgagggaggcgatacg

SEQ ID NO: 793655 - DNA, 690 bp, Homo sapiens
  misc_feature: 70532.44.9.A09.1.pb.heavy.1.raw 70532
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtagtcaagcggggaccgtctcgagggggctctcgcacaataatagacagccgtgtcctcacttgtgaggttgtacatttgcagatgcagtgtgttcctggaattgtctctggagacggtgaatcggcccttctcggagtctccgtagtgttcttcaattccatcttctgatataattgccacccactccagcccttgcctggagcctggcggacccagtgcatggcataggtcctgaagatgaatccagaggctgcacaggagagtctcaggagttcccaggctgggccgctcctcccccagactccactagctgcacctgacactggccacctcttaaaagagcaacgaggaaaacccatctcagcccaaagtccatggtgagtcctctgtgttcagtgatgatcaccgaatggaaacaccgcgacttccagtgctgggctcgtctccccccctgcgcgtctcgctaaatcgagcaccggtcgtgtatatactgtctgatggcgcgagggaggcgatacg

SEQ ID NO: 793656 - DNA, 702 bp, Homo sapiens
  misc_feature: 70586.44.55.E11.1.pb.heavy.1.raw 70586
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggtttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtggggtctcagtcatttatactggtgatttcacatactacgcagactccgtgaagggccgattcaccatctccagggacaattccaggaaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggcctgggctgcctggtcaaggactacttcctatatactgtctgagcggctggcaaggccatag

SEQ ID NO: 793657 - DNA, 679 bp, Homo sapiens
  misc_feature: 70590.UNK.UNK.UNK.pb.heavy.1.raw 70590
ctatgcgccttgccagcccgctcagacagtatataggaagtagtccttgaccagtcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttactttccatcagaccagatgactgccacccactccagccccttgcctggagcctgcggacccagtgcatggcagagtcactgaaactgagtccggacgcaacacaggagagtctcagggacgtcccaggctggacacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctctctcccagcccctttcccttactgactcactaaatcgagcaccgtcgtgtatatactgtctgatggcgcggaggaggcgatacg

SEQ ID NO: 793658 - DNA, 705 bp, Homo sapiens
  misc_feature: 70591.44.27.C05.1.pb.heavy.1.raw 70591
ctatgcgccttgccagcccgctcagacagtatataggaagtagtccttgaccaggcagcccagggccgctgtgctctcggaggtgctcctggagcaggggcgccaggggaagaccgatgggccccttggtggaggccgaggagacggtgaccagggttccctgcgcccaggcgtcgaatgaaccgattttggaaacaggatagtctcgcacaaaatacacggccgtgtcctgaggtctcaggctgttcatttgaagagacactgtgttctcggaattggtctctggagatggtgaatcggccctcacggaatcaccgtagacttgatttcctccatgaaatgacacacctgccacccactccagcccctcgctggagcctggcggacccactgcatattccaattatcgaaggtgaatccagaggctgcacaggagagtctcaggaccccccctactgggccacgcctccccagactccacgaattgcacctgacacatgacacctcttaagagggccaacgaggaaaacccagctcaggcccaaactccatggtgagtcctctgtgttcagtgatgatcaccgagtggaaacaccgggcgacttccagtgctgggctcgtctcccagccccaaacccttcgatcgcgtctaaatcgagcaccggtcgtgtatatactgtctgatggcgcgagggaggcgatacg

SEQ ID NO: 793659 - DNA, 651 bp, Homo sapiens
  misc_feature: 70595.UNK.UNK.UNK.pb.heavy.1.raw 70595
cgtattcgcctccctcgcgccatcagaccagtatatacacgacgacgcggtgctcgatttgagtacacgtgattagggattggggcaggggtgaacacctgtggttttcctcctgctcggtggcagctcccagatggggtcctgtcccaggtgcagctgcaggagtcgggcccaggactggtgaggcttcgggaacccgctgtctcgtcatctgcactgtctctgagtttccatccagtctctgatcattcttggggctggatccggcaggcccccagggagggaatggagtggattggtgcaccatccattatacctggggcgacgtactactctccgtccctcaagagtcgtctcaccatttcgaggggacacgtccgatgaagccgcttctccctgaaactgacctcccgtgaccgccgcggacacgcggccgtttatttctgtgcgaggcgagactggtcttgtcacatctatggggccgtggcaccgctggtcactgtctcctcagcttccaccaagggcccatcgggtcttcccgcctggcgccctgctccaggagcacctctggggcacagcggcctgggctgcctggtcaaggactacttcctatatacctgtctgagcggggctggcaagggcgcatagatc

SEQ ID NO: 793660 - DNA, 702 bp, Homo sapiens
  misc_feature: 70607.44.55.E11.1.pb.heavy.1.raw 70607
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793661 - DNA, 709 bp, Homo sapiens
  misc_feature: 70610.44.27.C05.1.pb.heavy.1.raw 70610
cgtatcgcctccctcgcgccatcagacagtatatacacgaccggtgctcgatttagacgcgatcgaagggtttggggagccctgggagacgagcccagcactggaagtcgccggtgttttccactcggtgatcatcactgaacacagaggactcaccatggagtttgggctgagctgggttttcctcgttgccctcttaagaggtgtcatgtgtcaggtgcaattcgtggagtctggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtcttcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793662 - DNA, 601 bp, Homo sapiens
  misc_feature: 70612.44.78.H01.1.pb.heavy.1.raw 70612
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccacagtcgaagccagggtgctggcggggctctcgcacgaaatcacggccgttgtccttcaatctcaggctgctcagttccatgtagactgtaccctgggcgacggtgctcctgggtcatactaactctgccttggaacttctgggcaaagcccgtgttgccactatagggcttcatccatcccatccactccgcccttgtccagcggccctgtcgcacccagttatatcccataattgatgaacgtgtatccagaagccgtgcaggagactgtcactgagggccccaggcttcttcacctcagccccagactgcacccagctgtacctgggaggtgggaccgtcagtcttcctcttccccccaaacccaaactactcacactaaatcgagcaccggtcgtgtatatactgtctgatggcgcgaggagggcgatacg

SEQ ID NO: 793663 - DNA, 541 bp, Homo sapiens
  misc_feature: 70614.44.38.D05.1.pb.heavy.1.raw 70614
cgtatcgcctccctcgcgccatcagacagtatatacacgaccggtgctcgatttagtatctgatagttcagcctggggggtccctgagactctcctgtgcagcctctggattcaccttcagtagctactggatgcactgggtccgcaagctccagggaaggggctggtgtgggtctcacgtattaatagtgatgggagtagcacaagctacgcggactcccgtgaagggccgattcaccatctccagagacaacgccaagaacacgctgtatctgcaaatgaacagtctgagagccgaggacacggctgtgtattactgtgcaagagccggtgcgggagtttcggggagttgcatactactactacggtatggacgtctggggccaagggaccaccggtcaccgtctcctcagcttccaccaagggcccatcggtctcccctgcgcctgctccagagcacctctgggggcacagcgccctgggctgcctggcaaggactacttcctaatatactgtctgagcgggctggcaaggcgcatag

SEQ ID NO: 793664 - DNA, 700 bp, Homo sapiens
  misc_feature: 70615.44.36.D03.1.pb.heavy.1.raw 70615
ctatgcgccttgccagccgctcagacagtatataggaagtagtccttgaccaggcagccagggccgctgtgctctcggaggtactcctggagcagggcgccagggggaagaccgatgggcccttggtggaggctgaggagacggtgaccagggttccctggcccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 793665 - DNA, 709 bp, Homo sapiens
  misc_feature: 70616.44.55.E11.1.pb.heavy.1.raw 70616
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttcccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 793666 - DNA, 674 bp, Homo sapiens
  misc_feature: 70639.44.45.E01.1.pb.heavy.1.raw 70639
ctatgcgccttgccagcccgctcagacagtatataggaagtagtcttgaccaggcagcccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagacagatgactgccaccactccagcccttgcctggagcctggcggacccagtgcatggcagagtcactgaaactgagtccggacgcaacacaggagagtctcagggacgtcccaagctggaccacgcctcccccagactccaccagctgaacctgacactggacacctcttaaaagagcaacgaggaaaaccagctcagccaaactccatggtgagtcctctgtgttcagtgctgatcaccgaatggaaacacgccgacttctagtgctggctctctccccagcccctttcccttactgactcactaaatcgagcaccggtcgtgtatatactgtctgatggcgcgagggaggcgatacg

SEQ ID NO: 793667 - DNA, 704 bp, Homo sapiens
  misc_feature: 70642.44.55.E11.1.pb.heavy.1.raw 70642
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggcccccagaagtcaaacgaataataaccactccgagcgccgacttgtctcgcacagtaatagacggccgtgtcgtccgcctctcaggttgttcatttgaagataaaccgtgttcctggaattgtccctggagatggtgaatcggcccttcacggagtctgcgtagtatgtgaaaatcaccagtataaatgactgagacccactccagccccttccctggagcctggcggacccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793668 - DNA, 611 bp, Homo sapiens
  misc_feature: 70647.44.36.D03.1.pb.heavy.1.raw 70647
ctatgcgccttgcccagcccgctcagacagtatataggaagtagtccttgaccaggcagcccagggccgctgtgccccagaggtgctcctggagcagggcgccagggggaagaccgatgggccttggtgggaagctgaggagacggtgaccgtggtcccctttgccccagacgtccagatggtaagacttataatacagaaaccagctgtttctttcccgcattacccgtgcacagtaatatgtgcctgtgtccgccagggtccatgttggtcatactaaagaccacctgccttttgaggtgtccttggagatggttaaactgctcttcagagatgtactgtaggattttttcgtcattcgagaagatgtgtgcaaggccactccagggccttccctgggggctgacggatccagctcacacccattctaatatcgttgagagagaacccagagatggtgcaggtccagcgtgaggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 793669 - DNA, 652 bp, Homo sapiens
  misc_feature: 70665.44.86.H09.1.pb.heavy.1.raw 70665
cgtatcgcctccctcgcgccatcagacagtatatacacgaccggtgctcgatttagtgctatagacttgggtttgggatgctttctgagagtcaggactcctgtgcaagaacatgaagcacctgtggtttttcctcctgctggtggcagctcccagatgggtcctgtcccaggtgcagctgcaggagtcgggccaggactggtgaggccttcggggaaccctgtctctcatctgcactggtctctggagtttccatcagttctgatcattcttggggctggatccggcagcccccagggaggggaatggagtggattggtgacatccattatactggggcggacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaaggggccatcggtcttcccctggcgccctgctccaggagcacctctggggcacagcggccctgggctgcctggtcaaggactacttcctatatactgtctgagcgggctggcaaggcgcatag

SEQ ID NO: 793670 - DNA, 730 bp, Homo sapiens
  misc_feature: 70702.44.33.C11.1.pb.heavy.1.raw 70702
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtcctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtccgccgtctcctcagcctccaccaagggcccatcggtcttccccctggcaccctcctcaagagcacctctgggggcacagcggccctgggctgcctggtcaaggactactttcctatatactgtctgagcgggctggcaaggcgcatag

SEQ ID NO: 793671 - DNA, 702 bp, Homo sapiens
  misc_feature: 70703.UNK.UNK.UNK.pb.heavy.1.raw 70703
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggcccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggaccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcggagcaccggtcgtgtatatactgtctgatggcgcgagggaggcgatacg

SEQ ID NO: 793672 - DNA, 543 bp, Homo sapiens
  misc_feature: 70709.44.43.D10.1.pb.heavy.1.raw 70709
cgtatcgcctcccgcgccatcagacagtatatacacgaccggtgctcgatttagactagcagtaagggctgaggtgaagaagcctggggcctcagtgaaggtctcctgcaaggcttctggatacaccttcaccaattatgatatcaactgggtgcgacaggccactggacaaggcttgagtgatgggatggatgaaccctaacagtggtaacacaggctatgcacagaagttccaggcagagtcaccatgaccaggaacacctccataaacacagcctacatggagctgagccagcctgagatctgaggacacggccgtgtattactgtggcgagatcccgaaagtatagccagctcgtccggggaggtggttcgaccccctgggccagggaaccctggtcacgcgtctcctcagcttccaccaagggcccatcgtcttcccctggcgccctgctcaggagcacctctgggggcacagcgctgggctgcctggtcaaggactacttcctatatactgtctgagcgggctggcaaggcgcatag

SEQ ID NO: 793673 - DNA, 574 bp, Homo sapiens
  misc_feature: 70710.UNK.UNK.UNK.pb.heavy.1.raw 70710
ctatgcggcccttgccagcccgctcagacagtatataggaagtagtccttgaccaggcagcccagggccgctgtgcccccagaggtgctcctggagcaggcgccagggggaagaccgatggggcccttggtggaagctgaggagacggtgaccgacgtccccctgccccagacatccatcaaatagttagtttatgattccccgaaccgtttccttggaggtccccctcgccacagtaataaacagacggtgtcgtcaactctcacgcctgttcatttgcaaatacagcatattcttggaattgtctctggagatggtgaatcggcccttcacggagtctgagtaatacttctcacttccatcgtcggagatgactgccacccactccggccccttgcctggagcctggcgggaccagtgcaaaccaaatctatcgaatgagaacccagaggctacacaggagagtctcagggacctcccgggctgacccgcctcccgcaaacccaacagtatgctactaaatcgagcaccgcgtcgtgtatatactgtctgatggcgcgagggaggcgatacg

SEQ ID NO: 793674 - DNA, 691 bp, Homo sapiens
  misc_feature: 70759.UNK.UNK.UNK.pb.heavy.1.raw 70759
ctatgcgccttgccagcccgctcagacagtatataggaagtagtccttgaccaggcagcccagggccgctgtgcccccagaggtgctcttggaggagggtgccaggggaagacgatggggcccttggtggaggcgaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctgaattgtcctggagatggtgaatcggcccttcacggagtctgcgtagtatgtgaaatcaccagtataatgactgagacccactccagcccccttccctggagcctggcggacccaactcatgtagttgctgctgacggtgagcccagaggctgcacaggagagtctctggaccccgcccaggctggactagccctcctcagactccatcagccgcacctcacactggacaccttttaaaagtccaacaaggagaacccagctcagcaaactccatggtgagtcctctgtgttcagtgctgatcacgaatggaaaacacctcgaatccagtgctgggctcctctccccaaaccaacgtgcgagtgctaaatcgagcacgtcgtgtatatactgtctgatggcgcgagggaggcgatacg

SEQ ID NO: 793675 - DNA, 612 bp, Homo sapiens
  misc_feature: 70766.UNK.UNK.UNK.pb.heavy.1.raw 70766
aggctgggcaggctatgccacccctggtccaggtcaaaagctgcggaacccgctaagcgccatcttggccactaggggtcccgcagattcatattgtcgtctagcatgcacaatgctgcaaacccagcttgcaatgcccacagcaagcggccaatcctttacgccacgttgaatttgtttattacctgtgactggctatggcttgcaacgccactcgtaaaactgtacctttgcgcgttaggggaagtagacaaaccattactccacttccggaagttcaactcattccaacacgaaataaaagtaaactcaacaccccaagcaggctatgtggggggtgattaggggtggattctatttcctatcccatcccctaggatctcaattaagttactagcgagttaaatgttctgtagcgatcccgtcagtcctatcgcgcgcatcaagacctggttggttgaggcgtgcatagatcatcgataagctgcgagttaggtcatccccagaccgcatctggcgcctaaacgttcagtgggtagctaaggcgtcaccttcgactgtctaaaggcaatatgtcgtccttagctccaagtccctagcaaggcgttcggg

SEQ ID NO: 793676 - DNA, 697 bp, Homo sapiens
  misc_feature: 70785.UNK.UNK.UNK.pb.heavy.1.raw 70785
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctgccccagtggacagttcctgatataaacacaacacaataatacatgcccgtgtcctcggttttcaggttagtcattcgcagaatcaatgagttcttgaagtcatctccttgagaggtgaatctggctttcacagacgcggccgtactctgtgataaagctggcaactttgtttttactgcggccaagccactccagccccttccctggagcctggcggacccagtccatatagtggtcactgatggtgaatccagaggcgacacaggagagtctcaggaccctccaggctggaccaagtctcccccggactccaccaactgcacttcactctggacaccttgtaaaataacacaaggaaaacccagctcagcccgaactccatggtgagtcctctgtgttcagtgctgatcaccaaatgaaaacacctgggaattctggggctggggctccgctctcccccaagagagatcgtgacgccagctaaatcgagcaccggtcgtgtatatactgtctgatggcgcgagggaggcgatacg

SEQ ID NO: 793677 - DNA, 611 bp, Homo sapiens
  misc_feature: 70787.UNK.UNK.UNK.pb.heavy.1.raw 70787
cccgacacgctttgctagggacttggagctaaggacgacatattgcctttagacagtcgaaggtgacgccttagctaccactgaacgtttaggcgccagatgcggtctgggatgacctaactcgcagcttatcgatgatctacttgcacgctcaaccaaccaaggtcttgatgcgcgcgatagactgacggatcgctacagacatttaactcgctagtaacttaaattgagatcctagggaatgggataggaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaaacaattcaacgtggcgtaaagattggccgcttgctgtgggcattgcaagctgggtttgcagcattgtgcatgctagaacgacaataattgaatctgcgggacccctagtggccaagatggcgctagcgggttccgcagcttttgacctgaccagggtgcatagcctgcccagccttc

SEQ ID NO: 793678 - DNA, 703 bp, Homo sapiens
  misc_feature: 70790.44.55.E11.1.pb.heavy.1.raw 70790
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctgggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacactcggaatcccagtgctgggctcctctccccccaaacccaacgtgcgagtgctaaatcgagcaccggtcgtgtatatactgtctgatggcgcgagggaggcgatacg

SEQ ID NO: 793679 - DNA, 707 bp, Homo sapiens
  misc_feature: 70828.44.55.E11.1.pb.heavy.1.raw 70828
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccaggggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttccctatatactgtctgagcgggctgcaaggcgcatag

SEQ ID NO: 793680 - DNA, 654 bp, Homo sapiens
  misc_feature: 70832.44.86.H09.1.pb.heavy.1.raw 70832
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctccaggagccacctctgggggcacagcggccctgggctgcctggtcaaggactacttcctatatactgtctgagcgggctggcaaggcgcatag

SEQ ID NO: 793681 - DNA, 611 bp, Homo sapiens
  misc_feature: 70837.UNK.UNK.UNK.pb.heavy.1.raw 70837
ccgacacgctgctagggacttggagctaaggacgacatattgcctttagacagtcgaaggtgacgccttagctaccactgaaacgttaggcgccagatgcggtctgggatgacctaacctcgcagcttatcgatgatctactgcacgctcaaaccaacccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtgggcggttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 793682 - DNA, 730 bp, Homo sapiens
  misc_feature: 70857.UNK.UNK.UNK.pb.heavy.1.raw 70857
cgtatgcgcctccctcgcgccatcagaccagtatatacgacgaccgtgctcgatttagctctacgctcagggcgggggagacgagcccagcactggaagtcgccgcgtgtttccattcacggtgatcatcactgaaacaccagaaggactcaccatggactttgggctgagatgggttttcctcgttgctcttttaagaggtggccagtgtcaggtgcagctagtggaggtctgggggaggagcggcccagcctggggaaactcctgagactctcctgtgcagcctctggattcatcttcaggacctaatgcgccatgcacgtggccgctccgcaggctccaggcaaggggctggagtgggtgggcaattatatcagaagatgaattgaagaacactacggagactcgagaaggggccgcgcgcgattcccagtctccagaggacaattccaggaacacactgcatctgcaaatgtacaactcacaagtgaggacacgggctgtctattattgtgcggagcgcggcctcgaggacccggtccgcccgcttgactactggggcccagggaagccctggtcaccgtctcctcagcctccaccaaggggcccatcggtcttcccctggcgccctgctccaggagcacctccgagagcacagcggccctgggctggcctggtcaaggactacttcctatatactgtctgagcggggctggcaaggccggcatag

SEQ ID NO: 793683 - DNA, 687 bp, Homo sapiens
  misc_feature: 70864.UNK.UNK.UNK.pb.heavy.1.raw 70864
ctatgcgccttgccagcccgctcagacagtatataggagagtagtcctgaccaggcagcccaggccgctgtgcccccagaggtgctctggaggagggtgccagggggagaccgatgggccttggtggaggcggaggcgacggtgaccagggttccctggccccagagtcaaacgataataaccactccgagcgccgacttgtctcgcacagtaatagacggccgtgtcgtcgcctctcaggtgttcatttgaagataaaccgtgttcctggattgtcctggagatggtgaatcggccttcacggagtctgcgtagtatgtgaaatcaccagtataaatgactgagacccactccagccccttcctggagcctggcggacccaactcatgtagttgctgctgacggtgagcccagagggctgcacaggagagtctctgggacccccaggctggactaagctcctccagactccatcagccgcacctcacactggacacctttaaaagtcaacaagagaacccagctcagccaaaactccatggtgagtcctctgtttcagtgctgatcaccgaatggaaaccacctcggaatcccagtgctgggctcctctccccaaacccaacgtgcgagtgctaatcgagcaccgcgtcgtgtatatactgtctgatggcgcgaggaggcgatacg

SEQ ID NO: 793684 - DNA, 661 bp, Homo sapiens
  misc_feature: 70866.UNK.UNK.UNK.pb.heavy.1.raw 70866
ctatgcgccttgccagcccgctcagacagtatataaggaagtagtccttgaccaggcagcccagggccgctgtgctctcggaggtgctcctggagcaggcgcccagggggaagaccgatgggcccttgggtggaaggcgatgagacggtgacctggattccctggcccccagggttcgaagaagcccgtggtccattgtggtcatgaagtgggcacagaaatatgtgcctgtgtccacaggtccacgttggtcaatgtaaggaccaggcctggtttttcggacgtgtccttcgtgagcgtgagtctggtcgtcagagaaggactatatcgtatatcgtcattccaataagtgagtgcgatccactccagggcctttccgggggctgccgcacccagacccacgccctctccaggagtgacgagtgagaagcctgagacggtgcaggtcagcgtgagggtctgtgtgggttgtcaccaatgtagggccagactctttcacggtgatctgggacaggccccatgaaaagggatggtcagcagcaggagcgtggagcaaaagtgtgtccatgggtggggcacaggagtcccccttactgactcactaaatcgagcaccgggtcgtggtatatactgtctgatggcggcgagggaggcgataccg

SEQ ID NO: 793685 - DNA, 655 bp, Homo sapiens
  misc_feature: 70881.44.86.H09.1.pb.heavy.1.raw 70881
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccccctcctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaaagcatccccaaacccaagtctatagcactaaatcgagcaccggtcgtgtatatactgtctgatggcgcgagggaggcgataccg

SEQ ID NO: 793686 - DNA, 674 bp, Homo sapiens
  misc_feature: 70890.44.6.A06.1.pb.heavy.1.raw 70890
cgtatcgcctccctcgcgccatcagacagtatatacacgaccggtgctcgatttagatctactgacaaccacattcctctctaaagaagcccctgggagcacagctcatcaccatggactggacctggaggttcctctttgtggtggcagcagcaacaggtgtccagtccctggtgcaactggtgcagtctgggactagaatggccgcaaccttggtcctcggtgaccctttcctgcacggcctcctggaagtactaccagttccactacttataccatcaactgggtgcgccaggccctggacaagggcttgagtggatggtggaatcatcctctttttggctcactcacctacgcacgagacttccggggcagaattacgattaccgcgaacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgcccttctccaggagcacctctggggggcacagcggccctgggctgcctggtcaaggactacttcctatatactgtctgagcgggctggcaaggcgcatag

SEQ ID NO: 793687 - DNA, 706 bp, Homo sapiens
  misc_feature: 70891.44.36.D03.1.pb.heavy.1.raw 70891
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggacttcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggtttggccgcagtaaaaacaaagttgccagctttatcacagagtacgccgcgtctgtgaaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgttctgagcgggctggcaaggcgcatag

SEQ ID NO: 793688 - DNA, 688 bp, Homo sapiens
  misc_feature: 70924.44.45.E01.1.pb.heavy.1.raw 70924
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgcggtccgccaggctccaggcaaggggctggagtggtggccagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctagacctggggccagggagccctggtcaccgtctcctcagcctccaccaagggcccatcggtcttccccctggcgccctgctccaggagcacctccgaggagcacagcggccctgggctgcctggtcaaggactacttcctatatactgtctgagcgggctggcaaggcgcatag

SEQ ID NO: 793689 - DNA, 618 bp, Homo sapiens
  misc_feature: 70927.44.38.D05.1.pb.heavy.1.raw 70927
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgacccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctccccggactccaccagctgcacctcacactggacaccttttaaaatagcaacaaggaaaacccagctatcagatactaaatcgagcaccggtcgtgtatatactgtctgatggcgcgaggaggcgatacg

SEQ ID NO: 793690 - DNA, 608 bp, Homo sapiens
  misc_feature: 70929.UNK.UNK.UNK.pb.heavy.1.raw 70929
cccgacacgcttgctagggacttggagctaaggacgacatattgcctttagacagtcgaaggtgacgcctttagctaccactgaacgtttaggcgccagatgcggttctgggatgacctaactcgcagcttatcgatgatctactgcacgctcaaccaaccaggtcttgatgcgcgcgataggactgacgggatcgctacagacatttaactcgctaggtaacttaattgagatctaggggatggaaataggaaatagaaaatccacccctatcacccccacataggcctgcttgggtgttgagtttacttttatttcgtgttggaatgagttgaacttccgggaagtggagtaatggtttgtctacttcccctaaccgcaaagtactagttttacgagtggcgttgcaagccatagccagtcacaggtaataaacaaatcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccaggtgcatagcctgccagccttc

SEQ ID NO: 793691 - DNA, 725 bp, Homo sapiens
  misc_feature: 70937.44.36.D03.1.pb.heavy.1.raw 70937
ctatgcgccttgccagcccgctcagacagttaatataggaagtagtccttgaccaggcagcccagggccgctgtgctctcggaggtgctcctggagcagggcggccagggggaagaccgatgggccttggtggaaggctggaggagacggtgaccagggttcccggcccccagtagtcaaaaccagccactgaccaagtgggcccgatcttctcgaacagaagtagacagcgtgtcctcgtctctcaggctgttcatttccagatacagtggagttcttggcattgtccctggaatggtggaatcggccctttcacagagtctgcgtagtaggtggtatctccagcaatattaacatatgaaacccactccagccccttccctggagcctggcgggacccagttcatggcatagtcactgaagatgaatccagaggctgcacaggagagtctcagggacccccccgctgtaccaaggccttccccagactccaccagccgcacctcacagtggaacaccttctaaaatagcaacaaggaaaaaacccagcgcagccccaactccatggtgagtcctctgtgttcattgcctgatcaccaagtggaaagccttggaatccaggctaaggcacctctctgagagctcccaaagaggagatcgtgacgcagctaaatcgagcaccggtcgtgtatatactgtctgatgggcgcgagggaggcgatacg

SEQ ID NO: 793692 - DNA, 703 bp, Homo sapiens
  misc_feature: 70940.UNK.UNK.UNK.pb.heavy.1.raw 70940
ctatgcgccttgccagcccgctcagacagtatataggaagtagtccttgaccaggcagcccagggccgctgtgctctcggaggtgctcctggagcagggcgcccagggggagaccgatgggcccttggtggaggctgaggagacggtgaccagggctcctggcccagtagagacgatgggctcgtacaataatagagagcgagtcctcggctctcaaattgttcattgtagatcacattccggtgttcttgaatgtctctggagacggagatcggccccttcacggagttttcccatagtattctttactatccatcagaccagatgaactggtccacccactccagccccttgcctggagcctgggcggacccagtggcatggcagcagtcactgaaactgagtccggtacgcaacacagcgagaagtctcaggggatcgtcccaggctggaccacgcctccccagactcacagctgaacctgacactggacacctcttaaaaagagcaacgaggaaaacccagctcagcccaaactccatggtgagtcctctgtgttcagtgctgatcacccgaatggaaacacgccgacttctagtgctggccctccttcccagcccctttccgcttactgactcactaaatcggagcaccgtcgtagtatatactgttctgatggctgccgacgcgggaggcgatacga

SEQ ID NO: 793693 - DNA, 706 bp, Homo sapiens
  misc_feature: 70951.UNK.UNK.UNK.pb.heavy.1.raw 70951
cgtatcgcctccctcgcgccatcagacagtatatacacgaccggtgctcgatttagcctgcgtcacgatctctcttggggagctctgagagcggagccccagccccagaattcccaggtgttttcatttggtgatcagcactgaacacagaggactcaccatggagttcgggctgagctggtttttccttgtttgttattttaaggtgtccagagtgaagtgcagttggtggagtccggggagacttggtccagcctggagggtccctgagactctcctgtgcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagaatgacttcaagaactcattgattctgcgaatgactaacctgaaaaccgaggaccacggggcatgtattattgtgttgtgtttatatcaggaaactgtccactggggccagggaaccctggtcaccggtctcctcagcctccacaagggcccatcggtcttccccctggcgcctgctccaggagcacctccgagagcacagcggcctgggcctgcctggtcaaggactaactttcctatatactgtctgagcgggctggcaaggcgcatag

SEQ ID NO: 793694 - DNA, 594 bp, Homo sapiens
  misc_feature: 70967.44.78.H01.1.pb.heavy.1.raw 70967
cgtatcgcctcccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaaactgggtgcgacaggccgctggacaagggctggagtggatgggatggatgaagccctatagtggcaacacgggctttgcccagaagttccaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggcccctgggctgcctggtcaaggactacttcctatatactgtctgagcgggctggcaaggcgcatag

SEQ ID NO: 793695 - DNA, 685 bp, Homo sapiens
  misc_feature: 71001.UNK.UNK.UNK.pb.heavy.1.raw 71001
ctatgcgccttgccagcccgctcagacagtatataggaagtagtccttgaccaggcagccagggccgctgtgcccccagagtgctcttggaggagggtgcaggggaagacgatgggccctggtgaggcggaggcgacggtgaccagggttccctggccccagaagtcaaacgaataataaccactcgagcgccgacttgtctcgcacagtaatagacggccgtgtcgtcgcctctcaggttgttcatttgaagataaaccgtgttcctggaatgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctggaccccccaggctggactaagcctcctcagactcatcagccgcacctcacactggacacctttaaaagtccaacaaggagaacccagctcagccaaaactccatggtgagtcctctgtgttcagtgctgatcaccgaatggaaacacctcggaatcccagtgctggctcctctcccaaacccaactgcgagtgctaaatcgagcaccggtcgtgtatatactgtctgatggcgcgaggaggcgatacg

SEQ ID NO: 793696 - DNA, 728 bp, Homo sapiens
  misc_feature: 71011.UNK.UNK.UNK.pb.heavy.1.raw 71011
cgtatcgccctccctcgcgccatcagacagtatatacacggaccggtggctcgatttaggctgcgtcacgatctctcttggggagctctgagaggcggagccccccagccccagaattcccaggtgttttcatttggtgatcagcactgaacacagagggactcaccatggagttcgggctgagctgggttttccttgttgttatttttacagggtgtccagagtgaagtgcagttggtggagtccgggggagacttggtccagcctggagggtccctgagactctctgtgtcgcctctggaatcaccatcagtgacccactatatggactgggtccgccaggctccagggaaggggctggagtggcttggccgcagtaaaaaccaaagttgccagctttatcacagagtacgcccgcgtctgtgaaagccagattcaccctctcaagagatgacttcagaagactcattgattctgcgaatgactaacctgaaaaccggaggacacgggcatgtattattgtgttgtgtttatatcaggaactgtccactggggccagggaacccccctggtcaccgtccctcagcctcaccaagggcccatcggtcttcccctggcgccctgctccaggagcacctccgagaggcacagcggccctgggctgccggtcaaggacctacttcctaatatactgctgagcgttcgagcgggctggcaagggcgcatag

SEQ ID NO: 793697 - DNA, 703 bp, Homo sapiens
  misc_feature: 71029.44.55.E11.1.pb.heavy.1.raw 71029
ctatgcgccttgccagcccgctcagacagtatataggaagtagtccttgacaggcagccagggccgctgtgcccccccagaggtgctcttggaggagggtgccagggggaagaccgatgggcccttggtggagcggaggcgacggtgacccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctccccccccaaacccaacgtgcgagtgctaaatcgagcaccggtcgtgtatatactgtctgatggcgcagggaggcgatacg

SEQ ID NO: 793698 - DNA, 606 bp, Homo sapiens
  misc_feature: 71047.UNK.UNK.UNK.pb.heavy.1.raw 71047
gaaggctgggcaggctatgcaccctggtccaggtcaaaagctgcggaacccgctagcggccatcttggccactagggtcccgcagattcatattgtcgtctagcatgcacaatgctgcaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggccgcctaaacgttcagtggtagctaaggcgtcaccttcgactgtctaaaggcaatatgtcgtccttagctccaagtccctagcaagcgtgtcggg

SEQ ID NO: 793699 - DNA, 591 bp, Homo sapiens
  misc_feature: 71105.UNK.UNK.UNK.pb.heavy.1.raw 71105
ctatgcgccttgccagcccgctcagacagtatatagaagtagtcttgaccaggcagcccaggccgctgtgccagaggtgctcctggagcaggcgccagggggaagaccgatgggccttggtggaagctgaggagacagtgacaggtgccacggccatagattgaaagacccagtctcgcctcccacagaaataacggccgtgtcgcggcggtcacggagtcagttttcagggagaagcggtcatggacgtgtcctcgaaatgtgagacgatcttgaggacggagagtagtacgtcgccccagtataatggtgtcacatccactccattcccctccctgggggctgcggatccagccccagaatgatcagaactgatggaaactccagagacagtgcagatggagacagggttcccgaaggcctcacagcctgggccgactcctggcagctgcacctggacaggacccatctgggagctgccacagcaggagaaaaccacaggtgttcaccctgcccaatccctatcacgtgtactaaaatcgggcaccggtcgtgtatatactgtctgatggcgcgagggaggcgataacg

SEQ ID NO: 793700 - DNA, 692 bp, Homo sapiens
  misc_feature: 71111.UNK.UNK.UNK.pb.heavy.1.raw 71111
ctatgcgccttgccagcccgctcagaacagtatataggaagtagtccttgaccaggcagcccagggccgctgtgccccagaggtgctcctggagcagggcgccagggggaagaccgatggcccttggtggaagctgaagagacggtgaccattgtcccctggcccaaatatcaaatgcatcgacgtcccaggatcgcctggcgcagtaatagacgcctgtgtcgtcgggtctcaggttgctcatttgtaaatggccaacactgttggagtcatccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaatcaagattagcccaaactccatggttggtggtctgtgctcagtgctgatcaccaagtggaaactcctgggaatctcacggctggggctcctctctcttgcgacgacactaaatcgagccaccggtcgtgtatatactgtctgatggcgcgaggaggcgatacg

SEQ ID NO: 793701 - DNA, 720 bp, Homo sapiens
  misc_feature: 71121.44.56.F01.1.pb.heavy.1.raw 71121
ctatgcgccttgccagcccgctcagacaggtatataggaagtagtccttgaccaggcagcccagggccgctgtgcccccagaggtgctcctggagcagggcgccaggggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccccccgactccgccagttcgcccctcgcactggacaccttctaaaaaaactacaaggaaaatcaagattagcccaaactccatggttggtgtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 793702 - DNA, 657 bp, Homo sapiens
  misc_feature: 71139.44.57.F02.1.pb.heavy.1.raw 71139
cgtattcgccctccctcgccgccatcagacagtatatacacgaccggtgctcgatttagctcgatatagttgggttgggatgctttctgagagtcaaggacctcctgtgcaagaacatgaagcacctgtggtttttcctcctgctggtggcagctccccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggccgacgtaactactctccgtccctcaagagtcgtctcacatttcgagggaaccgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793703 - DNA, 692 bp, Homo sapiens
  misc_feature: 71141.UNK.UNK.UNK.pb.heavy.1.raw 71141
ctatgcgccttgccagccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccgaatgaaaccatcccagacagtaatagacggctgtgtcctcggtgtttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaaggacttccccaggctttaccaaacctcccccagactccaccaactgcacctcacactggacaccttttaaaatagcagcaaggaaaatccagctcagccaaactccatggtgagtcctctgtgttcagtcctgatcactgaatgaaaacacctgggaatcccaaggctggggctcctctcccagagctccccaaaccccaaactactcacactaaatcgagcacgggtcgtgtatatactgtctgatggcgcgagggaggcgatacg

SEQ ID NO: 793704 - DNA, 627 bp, Homo sapiens
  misc_feature: 71142.UNK.UNK.UNK.pb.heavy.1.raw 71142
cggaacgcttggcaggcgacgtttgaggcatagagacgaacatattgcctttagacagtcctgaaggtgacgccttagctaccactgaaccgtttaggcgccagaatgcggtctgggatgaccctaactcgcagcttatcgatgatctactgcacgctcaccaaaccaggtcttgatgcgcgcgataggactgacgggatctgctaacagacatttaactcgctagtaacttaattgagatcctagggggatgggataggaaatagaatccacccctatcaccccccccacatagcctgcttggggtgttgagtttacttttatttccgtgttggaatgaagttgaacttccgggaagtggagtaatgggtttgtctacttccctaaccgcaaagtactagttttacgagtggcgttgcaaagccatagcccagtcacaggtaatataaacaattcaacgtgcgtaaagattggcccgctgctgtgggcattgcaagctggttttgcagcaatgtgcatgctagacgacaaatatgaaatctgcgggacccctagtggccaaagatggccgctagcgggttccgcagcttttgacctggaccagggtgcatagcctgcccagccttc

SEQ ID NO: 793705 - DNA, 604 bp, Homo sapiens
  misc_feature: 71150.UNK.UNK.UNK.pb.heavy.1.raw 71150
gaaggctgggcaggctatgcacccctggtccaggtcaaaagctgcggaaccgctaggccatcttggccactaggggtccgcagattcatatgtcgtctagcatgcacaatgctgcaaacccagcttgcaatgccaacagcaagcggcccaatcttacgccagcgttgaattgtttattacctgtgactggctatgcttgcaacgccactcgtaaaactagtactttgcggttaggggaagtagacaaacccattactccacttcccggaagttcaactcattccaacaccgaaataaaagtaactcaacaccccaagcaggctatgtgggggctggataggggtggattctatttcctatccatccctaggatctcaattaagttactagcgagttaaatgtctgtagcgatccgtcagtctatcgcgcgcatcaagactggttggttgagcgtgcagtagatcatcgataagctgcgagttaggtcatccagaccgcatctggcgcctaaacgttcagtggtagctaagcgtcaccttcgacgctgttctaaaggcaatatgtcgctccttagcctccaagtccctacaagcgaagcggtcgg

SEQ ID NO: 793706 - DNA, 641 bp, Homo sapiens
  misc_feature: 71171.UNK.UNK.UNK.pb.heavy.1.raw 71171
cgtatcgcctccctcgcgccatcagtctatactatcacgaaccggtgctcgatttagtgtcgtcgcaagagagaggggcccagccctggggactgaacagagagaacttcaccatggagtttgggctgagctggctttttcttgtggctgtttaaaaggtgtccagtgtgaagtgcagctgttggagtcgggggaggcggtacagccgggggggtccctgacactctcctgtgcagcctctggattcgcctttaatacctatgccatgatctgggtccgtcaggccccagggaaggggctggagtgggttctcatccattactgggtgtatgccacaaatgtcgcagactccgtgaagggccgctcatcgtctccagggacaattccaagaatacggttttctgcagatgaagagcctgcgagtggacgacaccggcccctttattactgtgccagagggtcgcaaaagttacaacaatacaaagtaattactactacatggacgtctggggcaaagggacccggtcaccgtctcctcagcctccaccaagggcccatcggtcttccccctggcaccctcctccaagagcacctctgggggcacagcggccctgggctgcctggtcaaggactacttccta

SEQ ID NO: 793707 - DNA, 608 bp, Homo sapiens; identical to SEQ ID NO: 792142
  misc_feature: 71185.UNK.UNK.UNK.pb.heavy.1.raw 71185

SEQ ID NO: 793708 - DNA, 617 bp, Homo sapiens
  misc_feature: 71193.UNK.UNK.UNK.pb.heavy.1.raw 71193
cgtatcgcctcctcgcgccatcagacagtatatacacgacggtgctcgatttagtacacgtgattagggattggggcagggtgaacacctgtggtttttcctcctgcctggtggcaggctcccagatgggtcctgtcccaggtgcagctgcaggagtcgggccaggactggtgaggccttcgggaaccctgtctctcatctgcactgtctctggagtttccatcagttctgatcattcttggggctggatcccggcaggcccccagggaggggaatggagtgattggtgacatccattatactggggcgacgtactactctccgtccctcaagagtcgtctcaccatttcgaggacacgtccatgaaccgcttctcctgaaactgacctccgtgaccgcgcggacacggccgtttatttctgtgcgaggcgagactggtctttcaatctatgggccgtggcaccctggtcactgtctcctcagcttcacaagggcccatcggtcttcccctggcgccctgctcaggagcacctctgggggcacagcggccctgggctgcctggtcagggagctacttcctcatatactgtctgagcgggctggcaaggcgcgcatag

SEQ ID NO: 793709 - DNA, 670 bp, Homo sapiens
  misc_feature: 71236.44.19.B08.1.pb.heavy.1.raw 71236
cgtatcgcctccctcgcgccatcagacagtatatacacgaccggtgctcgatttagtgagtcagtagggaaaggggctggagaggagcccagcactagagtcggcggtgtttccattcggtgatcagcactgaacacagaggactcaccatggagttgggctgagctggttttcctcgttgctcttttaagaggtgtccagtgtcaggttcagctggtggagtctgggggaggcgtggtccagcctggacgtcctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgatctccgtctccagagacaattccaagaacaccgtgtatctacaaatgaacaatttgagagccgaggactcgctctctattattgtacgagcccatcgttctactgggccagggagccctggtcaccgtctcctcagctccaccaagggcccatcgtcttccccctggcgccctgctccaggagcacctccgagagcacagcggcctgggctgcctggtcaaggactacttcctatatactgtctgagcgggctggcaaggcgcatag

SEQ ID NO: 793710 - DNA, 713 bp, Homo sapiens
  misc_feature: 71241.UNK.UNK.UNK.pb.heavy.1.raw 71241
cgtatcgcctccctcgcgccatcagacagtatatacacgaccggtgctcgatttagtagcgcataaagggaaaggggagctctgagagagggagcccagccctgggattttcaggtgtcttcatttggtgaccaggaccggaacagagagaagtctccatggagtttgggctgagctgcctttttcttgtggcttttttaaagggtgtcgtgtgtgaagtgcagttgttggagtctggggggggggcctgattcggcctgggaggtccctgaccctctcctgtgcggtcctctggattcacctttagtgcctatggcatgacctgggtccgccgggctccagggaggggactggagtggggtctcaagtatcggagctggtggtgtcactttctacggagactctgcgtgaagggccgcttcaccatttccagggacaattcgcaggacaaattgtttctccaaatgaaaaacctgagacccgaggacacacgtctattactgttgaaaagccaggaccacggtgaccccccatgacacctttagtacttggggccgggggacagtggtgaccgtctcttcagcctcccaccaagggcccatcggtcttcccctggcgccctgctccaggagcacctcgagagcacagcggccctgggctgcctggtcaaggactacttcctatatactgtagcgggctggcaaggcgcatag

SEQ ID NO: 793711 - DNA, 653 bp, Homo sapiens
  misc_feature: 71254.44.86.H09.1.pb.heavy.1.raw 71254
ctatgcgccttgccagcccgctcagacagtatataggaagtagtccttgaccaggcagcccagggccgctgtgcccccagaggtgctcctggagcagggcgccagggggaagaccgatgggccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgatagtatagactgatggcgcgaggaggcgatacg

SEQ ID NO: 793712 - DNA, 724 bp, Homo sapiens
  misc_feature: 71270.44.85.H08.1.pb.heavy.1.raw 71270
ctatgcgccttgccagccgcttcagacagtaatataggaagtagtccttgaccaggcagcccagggccgctgtgcccccagaggtgctcttggaggagggttgccaggggaagaccgatgggcccttggtggaggctgaggagacgtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggcctcctctcccagagctccccgcgactgagtgatactaaatcgagcaccggtcgtgtatatacctgtctgatggcgcgagggaggcgatacg

SEQ ID NO: 793713 - DNA, 712 bp, Homo sapiens
  misc_feature: 71283.UNK.UNK.UNK.pb.heavy.1.raw 71283
cgtatcgcctccctcgcgccatcagacagtatatacacgaccggtggctcgatttagacgcgatcgaagggtttgggctgggagacgagccagcactggaaagtcgccggtgtttccactcggtgatcatcactgaacacagagggactcaccatggagttggggctgagctggggttttcctcgttgccctcttaagaggtgtcatgtgtcaggtgcaattcgtggagagtctgggggaggcgtggccccagtagggggggtcctgagactctcctgtgcagcctctggattcaccttcgataattgaatatgcagtgggtccgccaggctccaggcgaggggctggaggtgcggtggcaggtgtgtcatttcatggaggggaaatcaagtctacggtgattccgttgagggccgattcaccatctccagagacaatttccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagccggccctggcttgcctggtcaaggactacttcctatatactgtctgagcgggctggcaaggcgcatag

SEQ ID NO: 793714 - DNA, 697 bp, Homo sapiens
  misc_feature: 71287.44.55.E11.1.pb.heavy.1.raw 71287
tatgcgccttgccagcccgctcagacagtatataggaagtagtccttgaccaggcagcccaggccgctgtgcccccagaggtgctcttggagagggtgccagggggaagaccgatgggcccttggtggaggcggaggcgacggtgaccagggttccctggcccagaagtcaaacgaataataacactccgagcgccgacttgtctcgcacagtaatagacggccgtgtcgtcgcctctcaggttgttcatttgaagataaacgtgttcctggaattgtccctggagatggtgaatcggcccttcacgagtctgcgtagtatgtgaaatcaccagtataaatgactgagaccccactccagccccttccctggagcctggcggacccaactcatgtagttggctgctgacggtgagccagaggctgccacaggagagtctctggaccccaggctggactaagcctcctccagactccatcagccgcacctcacactggacaccttttaaaagtccaacaaggagaaccagctcagccaaaactccatggtggagtcctctgtgttcagtgctgatcacccgaatggaaaacactcggaatcccagtgctgggctccttctcccaaacccaacgtgcgagtgctaaatcgagcaccggtcgtggtatatactgtctgatggcgcgagggaggcgatacg

SEQ ID NO: 793715 - DNA, 723 bp, Homo sapiens
  misc_feature: 71299.UNK.UNK.UNK.pb.heavy.1.raw 71299
cgtatcgcctccctcgcgccatcagacagtatatacacgacggtgctcgatttagtatcactcagtcgcggggagctctgggagaggagcccagcactagaagtcggcggtgtttccattcggtgatcagcactgaacacagaggactcaccatggagtttgggctgagctgggtttcctcgttgctccttttaagaggtgtccagtgtcaggtgcagctggtggagtctggggaggcgtgggtccaggcctgggagggtcccctgagactctcctgtgcagcgtctggattcaccttcagtacctatggcatgcactgggtccgccaggctccaggcaaggggctggagtgggtggcatctatatggtatgatggaagtaataaatactatgcagactcgtgaagggccgattcaccatctcagagacaattccaagaacacgctgtatctgcaaatgaacagcctgagaggcccgaggacacggctgtgtattactgtgcgaggacatattgtagtactgaccacctgctgggactactactacggtatggacgtctggggccaagggaccacggtcaccgtctcctcagcctccaccaagggccatcggtcttccccctgcaccctcctcaagagcacctctgggggcacagcggcccctgggctgcctggtcaaggactacttccatatactgtctgagcgggctggcaaggcgcatag

SEQ ID NO: 793716 - DNA, 706 bp, Homo sapiens
  misc_feature: 71320.44.27.C05.1.pb.heavy.1.raw 71320
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccggtgtcctgaggtctcaggctgttcatttgaagagacactgtgttctcgggaattgtctctggagatggtgaatcgccctcaaacggaatcaccgtagacttgatttcctccatgaaatgacacacctgcccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaaactccatggtgaagtcctctgtgttcagtgatgatcaccgagtggaaacaccggcgacttccagtgctggctcgtctccagcccaaacccttcgatcgcgtctaaatcgagcaccggtcgtgtatatactgtctgatggcgcgagggaggcgatacg

SEQ ID NO: 793717 - DNA, 707 bp, Homo sapiens
  misc_feature: 71323.UNK.UNK.UNK.pb.heavy.1.raw 71323
ctatgcgcctgccagcccgctccagacagtatataggaagtagtccttgaccaggcagccagggccgctgtgccccagaggtgctcctggagcagggcgccaggggggaagaccgatggccctggtggaagctgaggtgacaatgaccaggttccctgcccccagatctcaaaggctccatcgcgagctgggtacggacctctcgcacagtagtagacggccgtgtcgtcggatttcaaagaactcattgtcatgagactggtggtctgtggactttgtcccgcggtaatcgtaattctgccccggaagtctcgtgcgtaggtgagtgagccaaaaagaggggatgattccacccatccactcaagcccccttgtccagggggcctggcgcacccagttgatcgggtataaagtagtggaactggtagtaacttccagaggccgtgcaggaaagggtcaccggaggaccaaggttgcggcattctagttcccagactgcaccagttgcaccagggactggacacctgttgctggctgccacgcacaaagaggaacctccaggtccagtccatggtgatgagctgtgctccaggggcttctttagaggaggaatgtggttgttatgtgatgctccgcctgatagagctactaaatcgagcacccggtcgtgtatatactgtctgatggcgcgaggcgagggcgatacg

SEQ ID NO: 793718 - DNA, 619 bp, Homo sapiens
  misc_feature: 71327.44.23.C01.1.pb.heavy.1.raw 71327
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgcaccagcaggaggaaaaaccacaggtgttcaccctgcccaatccctaatcacgtgtactaaatcgagcaccggtcgtgtatatactgtctgatggcgcgagggaggcgatacg

SEQ ID NO: 793719 - DNA, 690 bp, Homo sapiens
  misc_feature: 71330.UNK.UNK.UNK.pb.heavy.1.raw 71330
ctatgcgccttgccagcccgctcagacagtatataggaagtagtcccttgaccaggcagcccagggccgctgtgctctcggaggtgctcctggagcagggcgccagggggaagaccgatggcccttggtggaggctgaggagacggtgaccagggttccctggcccgaatgaaacatcccagacagtaatagacggctgtgtcctcggtgttcaggctgttcatctgcagagacagccgtatcttttgaatcatctcttgagatggtgaatctgcctttcacgggtgcagcgtagtctgctgtcccaccgtcagctttggttctaatacggccaacccactccagcccccttccctggagcctggcggacccaggtcatccaggcgttactgaaagtgaatccagaggctgcacaggagagtctaagggactccccaggctttaccaaacctccccccagactccaccaactgcacctcacactgacaccttttaaaatagcagcaaggaaaatccagctcagcccaaactccatggtgagtcctctgtgttcagtcctgatcactgaatgaaaacacctgggaatcccaaggctggggctcctctcccagagctccccaaacccaaactactcacactaaatcgagcacggtcgtatatactgtctgatggcgcgagggaggcgatacg

SEQ ID NO: 793720 - DNA, 704 bp, Homo sapiens
  misc_feature: 71341.44.27.C05.1.pb.heavy.1.raw 71341
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793721 - DNA, 625 bp, Homo sapiens
  misc_feature: 71346.44.23.C01.1.pb.heavy.1.raw 71346
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattttctgtgcgaggcgagactggtcttttcaatctatggggccgtggcaccctggtcactgtctcctcagctttccaccaagggcccatcggtcttcccccctggcgccctgctccaggagcacctctggggacacagcggccctgggctgcctggtcaaggactacttcctatatactgtctgagcgggctggcaaggcgcatag

SEQ ID NO: 793722 - DNA, 707 bp, Homo sapiens
  misc_feature: 71359.44.67.G01.1.pb.heavy.1.raw 71359
cgtatcgcctccctcgcgccatcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattcccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793723 - DNA, 614 bp, Homo sapiens
  misc_feature: 71365.UNK.UNK.UNK.pb.heavy.1.raw 71365
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcggctagtaacttaattgagatcctagggatgggataggaaatagaatccaccctatcacccccccacatagcctgcttggggtgttgagtttacttttatttcgtgttggaatgagttgaacttccgggaagtgagtaatgggtttgtctacttcccctaaccgcaagtactagttttacgagtggcgttgcaagccatagccagtcacaggtaataaacaattcaacgtggcgtaaagattgggcgcttgctgtgggcattgcaagctgggtttgccagcattgtgccatgctagacgacaatatgaatctgcgggaacccctagtggccaagatggccgctagcggggttccgcagctttttgacctggaccagggtgcataggcctggccccaggccttc

SEQ ID NO: 793724 - DNA, 734 bp, Homo sapiens
  misc_feature: 71368.UNK.UNK.UNK.pb.heavy.1.raw 71368
cgtatcgcctccctcgcgccatcagacagtatatacacgacccggtgctcgatttagtatcactcagtcgcggggagctctgggagaggagcccagcatagaagtcggcgccgtgtttccattcggtgatcagcactggaacacagaggactcaccatggagttgtgggctgagctgggtttcctccgttgctcttttaaaggtgtccagtgtcagcgtgcagctgtggagttctggggagcgtgtccagcctgggaccggtcctgagactctcctggtgcagcgtctggattccccaccttccgcgtacctatggcatgcactgcggtccgccagggctcaggcaaggctggagtgggtggtgcacttatatggtatgatggagacctaataacgatgcagcgactcgtgaagggccgcattcaccatctccagagacattcaagaacacggctgtatctgcaaatgaacagcctgagagccgaggacacggctgtgtattactgtgcgaggacatattgtagtataccacctgctgggactactactacggtatgggacgtctggggccaaggaccaccggtcaccgtctcctccagcctcaccaagggcccatcggtcttcgccccctggcaccctcctccaagagcacctctggggcggcacagcgcctgtgctgcctggtcaaggactactcctatatactgtctgagcgggctgggcaaggcgcatag

SEQ ID NO: 793725 - DNA, 650 bp, Homo sapiens
  misc_feature: 71377.44.57.F02.1.pb.heavy.1.raw 71377
ctatgcgccttgccagcccgctcagacagtatataggaagtagtccttgaccaggcagcccagggccgctgtgcccccagaggtgctcctggagcagggcgccaggggaagaccgatggcccttggtggaagctgagggacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgcaccagcaggaggaaaaaccacaggtgcttcatgttcttgcacaggaggtccttgactctcagaaagcatcccaaacccaactatatcgagctaaatcgagcaccggtcgtgtatatactgtctgatggcgcgagggaggcgatacg

SEQ ID NO: 793726 - DNA, 631 bp, Homo sapiens
  misc_feature: 71381.UNK.UNK.UNK.pb.heavy.1.raw 71381
cgtatcgcctccctcgcgccatcagacagtatatacacgaccggtgctcgatttagtaacacgtgaattagggattggggccagggtgaacacctgtggtttttcctcctgctggtggcagctcccagatgggtcctgtcccaggtgcagctgcaggagtcgggcccaggactggtgagccttcgggaaccctgtctctcatctgcactgtctctggagtttccatcagttctgatcattcttggggctggatccggcagcccccaggggaggggaatggagtggattggtggacatccattatactggggcgacgtactctctccgtcctcaagagtcgtctcaccatttcgagggacacgtccatgaaccgcttctccctgaaactgacctccgtgaccgccgcggacacggccgtttatttctgtgcgaggcgagactgttctttcaatctatggggccgtggccaccctcagttcactgtcctctcagcttccaccaatgggcccatcggttctcttgccctggcgccccgctccaggagcaacctctgaggcacagcggccctgggctgcctggtcaagaactaccttccgttatatactgtctgatggcgggcggaggcgatacg

SEQ ID NO: 793727 - DNA, 689 bp, Homo sapiens
  misc_feature: 71382.UNK.UNK.UNK.pb.heavy.1.raw 71382
ctatgcgccttgccagcccgctcagacagtatataggaagtagtcttgaccaggcagcccagggccgctgtgccccagaggtgctcctggagcagggcgccaggggaagaccgatggcccttggtggaagctgaagagacggtgaccattgtcccctggccccaaatatcaaatgcatcgacgtcccaggatcgcctggcgcagtaatagacgcctgtgtcgtcgggtctcaggttgctcattttgtaaatggccaacactgttggagtcatcccttgagacggtgaatcttccttcacagacgcggcgtactctttacttccaccataacgttttcatttctgacgaaagtgatccactcaagccccttccctggagcctgacgaccaggccaagtgatatcactaagactgaatcctgagactacacaggagagtctcagagaccgccctggctgtgccaagcccccccgactccgccagtcgcccctcgcactggacaccttctaaaaaaactacaaggaaaatcaagattagcccaactccatggttggtggtctgtgctcagtgctgatcaccaagtggaaactcctgggaatctcacggctggggctcctctctcttgcgacgacactaaatcgagcaaccggtcgtgtatatactgtctgatggcgcgagggaggcgatacg

SEQ ID NO: 793728 - DNA, 668 bp, Homo sapiens
  misc_feature: 71386.44.38.D05.1.pb.heavy.1.raw 71386
cgtatcgcctcctcgcgccatcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctgggccaagggaccacggtcaccgtctcctcagcttccaccaagggcccatcggtcttccccctggcgccctgctccaggagcacctctgggggcacagcggccctgggctgcctggtaaggactacttcctatatactgtctgagcgggctggcaaggcgcatag

SEQ ID NO: 793729 - DNA, 705 bp, Homo sapiens
  misc_feature: 71390.44.36.D03.1.pb.heavy.1.raw 71390
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttatttcacaaggtgtccagagtgaagtgcagttggtggagtccgggggagacttggtccagcctggagggtccctgagactctcctgtgtcgcctctggattcaccatcagtgaccactatatggacttgggtccgccaggctccagggaaggggctggagtggcttggccgcagtaaaaacaaagttgccagcttatcacagagtacgccgcgtctgtgaaagccagattcaccctctcaagagatgacttcaagaactcattgattctgcgaatgactaacctgaaaaccgaggacacgggcatgtattattgtgtgttgtgtttatatcaggaactgtccactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793730 - DNA, 672 bp, Homo sapiens
  misc_feature: 71404.UNK.UNK.UNK.pb.heavy.1.raw 71404
cgtatcgcctcctcgcgccatcagacagtatatacacgaccggtgctcgatttagatctactggacaaccacattcctcctctaaagaagcccctgggagcacagctcatcaccatggactggacctggaggttcctctttgtggtgcagcagcacaggtgtccagtccctggtgcaactggtgcagtctggactagaatgccgcaaccttggtcctcggtgaccctttcctgcacggcctctggagtacccaccagttccactacttataccatcaactggtgcgccaggcccctggacagggcttgagtggatggggtggaatcatccctcttttttggctcactcacctacgcacgagacttccggggcagaattacgattaccgcggacaaagtccacagacacaggtctccatgacaatgagttctttgaaatccgacgacacggccgtctactactgtgcgagaggtccgtaccccagctcgcatggagcctttgagatctggggcagggaaccctggtcattgtcacctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793731 - DNA, 718 bp, Homo sapiens
  misc_feature: 71407.44.85.H08.1.pb.heavy.1.raw 71407
ctatgcgccttgccagcccgctcagacagtatataggaagtagtccttgaccaggcagcccagggccgctgtgcccccagaggtgctcttggaggaggtgccagggggaagaccgatggcccttggtggaggctgaggagacggtgaccgtggtcccttggccccagacgtccataccgtagtagtagtccagcaggtggtagtactacaatatgtcctcgcacagtaatacacagccgtgtctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctggctcctctcccagagctccccgcgactgagtgatactaaatcgagcaccggtcgtgtatatactgtctgatggcgcgagggaggcgatacg

SEQ ID NO: 793732 - DNA, 705 bp, Homo sapiens
  misc_feature: 71419.44.67.G01.1.pb.heavy.1.raw 71419
ctatgcgccttgccagcccgctcagacagtatataggaagtagtccttgaccaggcagcccagggccgctgtgcccccagaggtgctcttggaggagggtgccaggggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttccctggaattgtccctggagatggtgaatcggccttcacggagtctgcgtagtatgtgaaatcaccagtataaaaggactgagacccactccagccccttcctggagcctggcggacccaactcatgtagttgctgcctgacggtgagcccagaggctgcacaggagagtctctggaccccccaggctggactaagcctcctccagactccatcagccgcactcacactggacacctttaaaagtccaacaaggagaacccagctcagccaaaactccatggtgagtcctctgtgttcagtgctgatcacccgaatggaacacctcggaaatcccagtgctgggctcctctccccccaaacccaatatgtatactctaaatcgagcaccggtcgtgtatatactgtctgatggcgcgagggaggcgatacg

SEQ ID NO: 793733 - DNA, 659 bp, Homo sapiens
  misc_feature: 71427.UNK.UNK.UNK.pb.heavy.1.raw 71427
cgtatcgcctcccctccgcgccatcagtctatactatcacggaccgcgtgctcgatttagagagagtgtgttggttttggggggaagcacctgtggtttcttcctccttgctggtggcggctcccagatgggtcctgtctcagccgcagctgcggagtcgggcccaggactggtgaagccttcggagaccctgtccctcacgtgcacggtctctggtgcctccatcgacagaagtaatttctactgggctggatccgccagcccccaggagagggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctggggccaagggaccacgtcaccgtctcctcatcctcagcctccaccaagggcccatcggtttcccctggcgcgccctgctccaggagcacctccgagaggcacagcggcctggctgcctggtcaaggactacttcctatatactgtctgagcgggctggcaaggcgcatag

SEQ ID NO: 793734 - DNA, 680 bp, Homo sapiens
  misc_feature: 71428.44.74.G08.1.pb.heavy.1.raw 71428
cgtatcgcctcctcgcgccatcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactgtgcagtctgggactagaatgccgcaacctggtcctcggtgaccctttcctgcacggcctctggaagtactacagttccactacttataccatcactgggtgcgccaggcccctggacaagggcttgagtggatgggtggaatcatccctctttttggctcactcacctacgcacgagacttccggggcagaattacgattaccgcggacaagtcacagacacagtctccatgacaatgagttctttgaaatccgacgacacggccgtctactactgtgcgagaggtcgtaccccagctcgcatggagcctttgagatctggggcagggaaccctggtcattgtcactcagcttccaccaagggccatcggtcttcccctggcgcctgctccaggagcacctctggggcacagcggccctgggctgcctggtcaaggactacttcctatatactgtctgagcgggctggcaaggcgcatag

SEQ ID NO: 793735 - DNA, 607 bp, Homo sapiens
  misc_feature: 71429.UNK.UNK.UNK.pb.heavy.1.raw 71429
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 793736 - DNA, 654 bp, Homo sapiens
  misc_feature: 71431.44.12.B01.1.pb.heavy.1.raw 71431
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggctggagtggattggagtatctattatagtgggagcacctactacaacccgtccctcagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcgtcttcccctggcaccctcctccaagagcacctctgggggcacagcggcctgggctgcctggtcaaggactacttcctatatactgtctgagcgggcggcaaggcgca

SEQ ID NO: 793737 - DNA, 681 bp, Homo sapiens
  misc_feature: 71432.44.45.E01.1.pb.heavy.1.raw 71432
cgtatcgcctccctcgcgccatcagacagtatatacacgaccggtgctcgatttagtgagtcagtaagggaaaggggctgggagaggagcccagcactagaagtcggcggtgttttccattccgtgatcagcactgaacacagaggactcaccatggagtttgggctgagctgggtttcctcgttgctcttttaagaggtgtccagtgtcaggttcagctggtgagtctggggaggcgtggtccagcctgggacgtccctgagactctctgtgttgcgccggactcgtttcagtgactctgccatgcactgggtccgccaggctccagcaagggctggagtgggtggcagtcatctggtctgatggaagtaaagaatactatggaaactccgtgaagggccgattctccgtctccagagacaattcccaagaacaccgtgtatctacaaatgaacaattttgagagccgaggactcggcctctctattattgtacggagcccatcgttcctactggggccagggagccctggtcaccgtctcctcagcctccaccaagggcccatcggtcttccccctggcgccctgctccaggagcactccgagagcacagcggccctgggctgccctggtcaaggactacttcctatatactgtctgagcgggctggcaaggcgcatag

SEQ ID NO: 793738 - DNA, 681 bp, Homo sapiens
  misc_feature: 71444.44.73.G07.1.pb.heavy.1.raw 71444
cgtatcgcctcctcgcgccatcagacagtatatacacgaccggtgctcgattagctctacgctcaggggggagacgagcccagcactgaagtcgccggtgtttccattcggtgatcatcactgaacacagaggactcaccatggactttgggctgagatgggttttcctcgttgctcttttaagaggtggccagtgtcaggtgcagctagtgagtctggggaggagcggcccagcctgggaactcctgagactctcctgtgcagcctctggattcatcttcaggacctatgccatgcactgggtccgccaggctccaggcaaggggctggagtggtggcaattatatcagaagatggaattgaagaacactacggagactccgagaagggccgattcaccgtctcagagacaattccaggaacacactgcatctgcaaatgtacaacctcacaagtgaggacacggctgtctattattgtgcgagagccccctcgagacggtcccgctgactactggggccagggaaccctggtcaccgtctcctcagcctccaccaagggcccatcggtcttccccctggcgccctgctccaggagcacctccgagagcacagcggcctgggctgcctggtcaaggactacttcctatatactgtctgagcgggctggcaaggcgcatag

SEQ ID NO: 793739 - DNA, 678 bp, Homo sapiens
  misc_feature: 71447.44.45.E01.1.pb.heavy.1.raw 71447
ctatgcgccttgccagcccgctcagacagtatataggaagtagtccttgaccaggcagcccagggccgctgtgctctcggaggtgctcctggagcagggcgccagggggaagaccgatggcccttggtggaggctgaggagacggtgaccagggctccctggcccagtagaacgatgggctcgtacaataatagagagccgagtctcggctctcaaattgttcattgtagaacacggtgttcttggaattgtctctggagacggagaatcggcccttcacggagtttccatagtattctttacttccatcagaccagatgactgccacccactcagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 793740 - DNA, 665 bp, Homo sapiens
  misc_feature: 71467.UNK.UNK.UNK.pb.heavy.1.raw 71467
cgtatcgcctccctcgcgccatcagacagtatatacacgacggtgctcgatttagatctactgacaaaccacattcctcctctaaagaagccctgggagcacagctcatcaccatggactggacctggaggttcctctttgtggtggcagcagcaacaggtgtccagtccctggtgcaactggtgcagtctgggactagaatgccgcaaccttggtcctcggtgacctttcctgcacggcctctggaagtactaccagttccactacttataccatcaactgggtgcgccaggccctggacaagggcttgagtggatgggtggaatcatccctctttttggctcactcacctacgcacgagacttccgggcagaattacgattacgcggacaagtccacagacacagtctccatgacaatgagttctttgaatccgacgacacggccgtctactactgtgcgagaggtccgtaccccagctcgcatggagcctttgagatctggggcagggaaccctggtcattgtcacctcagcttccaccaagggccatcggtcttcccctggcgccctgctccaggagcacctctggggcacagcggccctgggctgcctggtcaaggactacttcctatatactgtctgagcgggctggcaaggcgcatag

SEQ ID NO: 793741 - DNA, 693 bp, Homo sapiens
  misc_feature: 71495.UNK.UNK.UNK.pb.heavy.1.raw 71495
cgtatcgcctcctcgcgccatcagacagtatatacacgacggtgccgatttagctgcgtcacgatctctcttggggaagctctgagagcggagccccagcccagaattcccaggtgtttcattggtgatcagcactgaacacagaggactcacatggatttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggcccaggaaggggctggagtggcttggcgcagttaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcactccgagagcacagcggcctgggctgcctggtcaaggactacttcctatatactgtctgagcgggctggcaaggcgcatag

SEQ ID NO: 793742 - DNA, 659 bp, Homo sapiens
  misc_feature: 71499.44.86.H09.1.pb.heavy.1.raw 71499
ctatgcgccttgccagcccgctcagacagtatataggaagtagtccttgaaccaggcagcccagggccgctgtgcccccagaggtgctcctggagcagggcgccagggggaagaccgatgggcccttggtggaagcctgaggagacagtgaccagggtgccacggcccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacaagggttcccgaaggcctcaccagtcctgggcccgactcctgccagctgcacctgggacaggacccatctgggagctgccaccagcaggaggaaaaccacaggtgcttcatgttcttgcacaggaggtccttgactctcagaaaagcatccccaaacccaagtctatagcactaatcgagcaccggtcgtgtatatactgtctgatggcgcgagggaggcgatacg

SEQ ID NO: 793743 - DNA, 728 bp, Homo sapiens
  misc_feature: 71501.44.85.H08.1.pb.heavy.1.raw 71501
cgtatcgcctccctcggcgccatcagacagtatatacacgaccggtgctcgatttagtatcactcagtcgcgggagctctgggagaggagcccagcactagaagtcggccggtgtttccattcggtgatcagcactgaacacagaggactcaccatggagtttgggctgagctgggttttctcgttactctttttaaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcacatctccagagacaattccaagaacacgctgtatctgcaaatgaacagcctgagagcccgaggacacggctgtgtattactgtgccgaggacatattgtagtactaccacctgctgggactactactacgggtatggacgtctgggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793744 - DNA, 704 bp, Homo sapiens
  misc_feature: 71510.UNK.UNK.UNK.pb.heavy.1.raw 71510
ctatgcgccttgccagcccgctcagacagtatataggaagtagtccttgaccaggcagcccagggccgctgtgcccccagaggtgctcttggaggaggggtgccaggggaagaccgatgggcccttggtggaggcggaggcgacggtgaccaggttccctggccccagaagtcaaacgaataataaccactccgagcgccgactgttctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtggctgatcaccgaatggaaacacctcggaatccagtgctgggctcctctccccccaaacccaacgtgcgagtgctaaatcgagcacgcgtcgtgtatatactgtctgatggcgcgagggaggcgatacg

SEQ ID NO: 793745 - DNA, 645 bp, Homo sapiens
  misc_feature: 71514.UNK.UNK.UNK.pb.heavy.1.raw 71514
cgtatcgcctcctcgcgccatcagacagtatatacacgacggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccagactggtgaggccttcgggaaccctgtctctcatctgcactgtctctggagtttccatcagttctgatcattcttgggctggatccggcagcccccagggaggggaatgagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaaggcccatcggtcttccccctggcgccctgctccaggagcacctctggggcacagcgccctgggctgcctggtcaaggactacttcctatatactgtctgagcgggctggcaaggcgcatag

SEQ ID NO: 793746 - DNA, 685 bp, Homo sapiens
  misc_feature: 71516.UNK.UNK.UNK.pb.heavy.1.raw 71516
cgtatcggcctcctcgcgccatcagacagtatatacacgacggtgctccgatttaggctctacgctcagggccgctgtgctctcggcgggtttccattcggtgatcagcactcgaacacagaggactcaccatggagtttgggctgagctgggtttcctcgttactcttttagaggtgtccagtgtcaggtttgcacctggtggagtctgggggaggcgtggtccagcctggaggctccctgagcactctcctgtgaagcctctggatttagtttcagtagttctggcatgcactggttccgccaggctccaggcaaggggccggagtgttggccagttatagcatatgatggaacttctagatatttatgccagactccgtgaagggccgattcaccatctccagagacaattccggaacactctgtacctggaaatgatcagcctgagaggcgaggactcggctctgtatactgtgcggatcggaagtggcagcagctattatcgggccgtttcactgggcccagggaactggtcaccgtccctcagcctccaccaagggcccatcgtcttcccctggcggcccctgctccagggagcacctccgagagcacagcggccctggctgcctggtcaagggactacttccgtatatactgtctgagcggggctgcaaggcgcatag

SEQ ID NO: 793747 - DNA, 660 bp, Homo sapiens
  misc_feature: 71517.44.12.B01.1.pb.heavy.1.raw 71517
cgtatcgcctccctcgcgccatcagacagtattacacgaccggtgctcgatttagtagtgtagattccgcgggggctttctgagagtcatggacctcctgtgcaagaacatgaagcactgtggttcttcctcctgctggtggcggctcccagatgggtcctgtcccagctgcagctgcaggagtcggcccaggactggtgaagccttcggagaccctgtccctcacctgcactgtctctggtggctccatcagcagtagtagttactactggggctggatccgccagccccccagggaaggggctggagtggattgggagtatctattatagtgggagcacctactacaacccgtccctcaagagtcgagtcaccatatcagtagacacgtccaagaaccagttctccctgaagctgagctctgtgaccgcgcggacacggccgtgtatactgtgcgagagtagggcagttcgtcaccaactactttgaccactggggcagggaaccctgggtcaccgtctcctcagcctccaccaagggcccatcggtcttccccctggcaccctcctccaagagcacctctggggggcacagcggccctgggctgcctggtcaaggactacttcctatatactgtcgagcgggctggcaggcgcatag

SEQ ID NO: 793748 - DNA, 734 bp, Homo sapiens
  misc_feature: 71533.UNK.UNK.UNK.pb.heavy.1.raw 71533
cgtatcgctccctcgcgccatcagacagtatatacacgaccgggtgctcgatttagagtgagctcgttgggtttggggactctgggagaaggagcccagcacccagaagtcggggcggtgtttccagtcggtgatcagcaccgaacacaaggactcaccatgggttttggggctgacctgggtttttcctcgtttgctcttttaagaggtgtccagtgtcaggtgaagctggtggagtctggggaggcgtggtccagctgggaggtccctgagactctcctgttgtagcgtctggattcacctcaacagacatggcatgcactggtccgccaggctccaaggcaagggactggagtgggtggcacttatatggtatgatggaagtaataaatattatgtagattccgtgaagggccgattcaccatctccagagacaattcgaaagaacacactatatctggaaatgaatagcctgagagccgaggacacggctgtctactactgtgcgagagatgggggctcgtggatacagatatgacatgctctactccaatggtatggacgcctggggccaagggaccacggtcgccgtctcctcagcctccaccaaggcccatcggtcttcccctggcaccctcctccaagagcacctctgggggcacagcggccctgggctgcctggtcaaggactacttccctatatactgtctgagcgggctggcaaggcgcatag

SEQ ID NO: 793749 - DNA, 645 bp, Homo sapiens
  misc_feature: 71583.UNK.UNK.UNK.pb.heavy.1.raw 71583
cgtatcgcctccctcgcgccatcagacagtatatacacgaccggtgctcgatttagtagtctcataagggaaatgctttctgagagtcaaggacctcctgtgcaagaacatgaagcacctgtggttttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagccccagggaggggaatggagtgattggtgacatccattatactgggcgacgtactactctccgtccctcaagagtcgtctcaccatttcgagggacacgtccatgaaccgcttctccctgaaactgacctccgtgaccgccgcgacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793750 - DNA, 707 bp, Homo sapiens
  misc_feature: 71584.UNK.UNK.UNK.pb.heavy.1.raw 71584
cgtatgcctccctctgcgccatcagacagtatatacacgcccgtgctcgatttagctgcgtcacgatctctcttggggagctctgagagcggagcccagcccagaattcccaggtgttttcatttgtgatcagcactgacccacagaggactacaccatggagttcgggctgagcctgggtttccttggtttgttattttacaacggtgtccagagtgaagtggcagttggtggagtcggcggagacttggtccagcctggaggtccctgagactctcctgtgtcgcctctggattcaccatcagtgaccactatatggaccctgggtccgccaggctccaggaagggggctgagtggctggccgcagtaaaaacaaagttgccagctttatcacagagtacgccgcgtctgtgaaagccagattcaccctctcaagagatgacttcaagaactcatgatctgcgaatgactaacctgaaaaccgaggacactggcatgttatttatgttgtgttgtgtttatatcaggaactgtccactgggggccagggaacctggtcaccgtctcctcagcctcccaccaagggcccatcggtcttccccctggcgctctgctccaggagcacctcgagagcacagcggccctggctgcctgggtcaaggactacttcctatatacctgtctgagcgggctgcaaggcgcatag

SEQ ID NO: 793751 - DNA, 652 bp, Homo sapiens
  misc_feature: 71601.44.53.E09.1.pb.heavy.1.raw 71601
cgtatcgcctccctcgcgccatcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtcctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttcctgaaagtgagttctgtggccgccgccgacacggctgtctactactgtgtcagacatgggtccgcctatggcaggtcgtctcaattctactacgcttgggacgtctggggccaagggaccacggtcaccgtctcctcatcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793752 - DNA, 728 bp, Homo sapiens
  misc_feature: 71617.44.33.C11.1.pb.heavy.1.raw 71617
cgtatcgcctccctcgcgcctcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccacaagggcccatcggtcttccccctggcaccctcctccaagagcacctctgggggcacagcggccctgggcctgcctggtcaaggactacttcctatatactgtctgagcgggctggcaaggcgcatag

SEQ ID NO: 793753 - DNA, 643 bp, Homo sapiens
  misc_feature: 71639.44.86.H09.1.pb.heavy.1.raw 71639
ctatgcgccttgccagcccgctcagacagtatataggaagtaccttgaccagcagcccaggccgctgtgccccagaggtgctcctggagcagggcgccaggggaagaccgatgggcccttggtggaagctgaggagacagtgaccaggtgccacggccccatagattgaaagaccagtccgcctcgcacagaaataaacggccgtgtcccgcgcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccagaatgatcagaactgatggaaactccagagacagtgcagatgagagacagggttcccgaaggcctcaccagtcctggcccgactcctgcagctgcacctgggacaggacccatctgggagctgccacagcaggaggaaaaaccacaggtgcttcatgttcttgcacaggaggtcttgactcccagaaagcatccccaaacccaagtctatagcactaaatcgagcaccggtcgtgtatatactgtctgatggcgcgagggaggcgatacgg

SEQ ID NO: 793754 - DNA, 665 bp, Homo sapiens; identical to SEQ ID NO: 791013
  misc_feature: 71650.44.12.B01.1.pb.heavy.1.raw 71650

SEQ ID NO: 793755 - DNA, 703 bp, Homo sapiens
  misc_feature: 71655.44.36.D03.1.pb.heavy.1.raw 71655
cgtatcgcctccctcgcgccatcagacagtatatacacgaccggtgctcgatttagctgcgtcacgatctctcttggggggagagcggagccccagccccagaattcccaggtgttttcatttggtgatcagcactgaacacagaggactcaccatggagttcgggctgagctggggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaaagccagattcacctctcaagagatgacttcaagaaactcattgattctgcgaatgactaacctgaaaaccgaggacacgggcatgtattattgtgttgtgtttatatcaggaactgtccactggggccagggaaccctgggtcaccgtctcctcagcctccaccaagggcccatcggtcttccccctggcgccctgctccaggagcacctccgagagcacagcggccctgggctgcctggtcaaggactacttcctatatactgtctgagcgggctggcaaagcgcatag

SEQ ID NO: 793756 - DNA, 730 bp, Homo sapiens
  misc_feature: 71665.UNK.UNK.UNK.pb.heavy.1.raw 71665
ctatgcgccttgccagccgctccagacagtatactaggaaaagtaagtcctgaccaggcagccaagggcgctgtgctctcggaggtgctcctggagcagggcgccagggggaagaccgatgggcccttgctggaggctgaggagacggtgaccagggttccctggccccagtggacagttcctgatatacaacacaacacaataaataccatgcgccgtgtcctcggttttcaggttagtcattcgcagaatcaatgagttcttgaagtcatcttctatgagagggtgaatctggctttcacagacgccggtcgtgagctctgctgataaagctggcaactttgtttttactcgcggccaagccactccagccccttccctggagcctggcggacccagtccatatagtgggtcactgatggtggaatccagaggcgaccacagagagtctcagggaccctccaggctgaccagtctccccggactccaccaactgcacttcactctggacaccttgtaaaaataacaacaaggaaaacccagctcagccgaactccatggtgagctctctctgtgttcagtgctgatcaccaaatgaaaacaccgggaattctgggactgtcggctccgctctcagagctcccctaagagagatcgtgacgcagcctaaatcgcgagcaccggtctggttatacaaccgtgtctgatggcggcgaggcgaggcgatacg

SEQ ID NO: 793757 - DNA, 670 bp, Homo sapiens
  misc_feature: 71667.44.38.D05.1.pb.heavy.1.raw 71667
ctatgcgcccttgccagcccgctcagacagtatataggaagtagtccttgaccaggcagccagggccgctgtgcccccagaggtgctcctggagcagggcgccaggggaagaccgatggcccttggtggaagctgaggagacggtgaccgtggtcccttggccccagacgtccataccgtagtagtagtatggcaactccccgaactcccgcaccggctcttgcacagtaatacacagccgtgtcctcggctctcagactgtttcatttgcagatacagcgtgttcttggcgttgtctctggagatggtgaatcggcccttcacggagtccgcgtagcttgtgctactcccatcactattaatacgtgagaccacaccagccccttccctggagcttggcggacccagtgcatccagtagctactgaaggtgaatccagaggctgcacaggagagtctcagggaccccccaggctgaactaagcctccccatgcccacggtgcccagagcccaaatcttgtgacacacctcccccgtgcccaaggtgcccagcacctgaactcctgggaggaccgtcagtcttcctcttcccccccaaacccaactatcagatactaaatcgagcaccggtcgtgtatatactgtctgatggcgcgagggaggcgatacg

SEQ ID NO: 793758 - DNA, 698 bp, Homo sapiens
  misc_feature: 71676.UNK.UNK.UNK.pb.heavy.1.raw 71676
cgtatcgcctccctcgcgccatcagacagtatatacacgacggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctcctgtgcagctctgggctcaccgtcagcagcaactacatgagttgggtccgccaggctccagggaaggggctggagtgggtctcagtcatttatactggtgatttcacatactacgcagactccgtgaagggccgatcaccatctccagggacaattccaggaacacggtttatcttcaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 793759 - DNA, 680 bp, Homo sapiens
  misc_feature: 71686.44.45.E01.1.pb.heavy.1.raw 71686
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcaggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagccctttcccttactgactcactaaatcgagcaccggtcgtgtatatactgtctgatggcgcgagggaggcgatacg

SEQ ID NO: 793760 - DNA, 699 bp, Homo sapiens
  misc_feature: 71755.44.71.G05.1.pb.heavy.1.raw 71755
cgtatcgcctccctcgcgccatcagacagtatatacacgaccggtgctcgatttagtgtcgtcgcaagagagaggagccccagccgtgagattcccaggagtttccactttggtgatcagcactgagcacagaccaccaaccatggagtttgggctaatcttgattttccttgtagttttttttaagaaggtgtccagtgcgaggggcgactggcggagtcggggggggcttggcacagccagggcggtctctgagactcctcctgtgtagtctcaggattcagtcttagtgattatcacttggcctggtccgtcaggctccagggaaggggcttgagtggatcactttcgtcagaatgaaacgttatggtggaagtaaagagtacgccgcgtctgtgaagggaagattcaccgtctccaagggatgactccaacagtgtttggccatttacaaatgagcaacctgagacccgacgacacaggcgtctattacttgcgccaggcgatcctgggacgtcgatgcatttgatatttggggccaggggacaatggtcaccgtctcttcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 793761 - DNA, 692 bp, Homo sapiens
  misc_feature: 71765.44.56.F01.1.pb.heavy.1.raw 71765
ctatgcgccttgccagcccgctcagacagtatataggaagtagtccttgaccaggcagccaggccgctgtgccccagaggtgctcctggagcagggcgccaggggagaccgatgggcccttgtggaagctgaagagacggtgaccattgtccctggcccaaatatcaaatgcatcgacgtccaggatcgcctggcgcagtaatagacgcctgtgtcgtcggtctcaggttgctcatttgtaaatggccaacactgttggagtcatcccttgagacggtgaatcttcccttcacagacgcggcgtactctttacttccaccataacgtttcatctgacgaaagtgatccactcaagcccttcctggagcctgacggacccaggccaagtgataatcactaagactgaatcctgagactacacaggagagtctcagagaccgccctggctgtgccaagcccccccgactcgccagtcgccctcgcactggacaccttctaaaaaaactacaaggaaaatcaagattagccaaactccatggttggtggtctgtgctcagtgctgatcaccaagtggaaactcctggaatctcacgctgggctcctctcccagagctccctttgtgtgttcagacgtctgctaaatcgagcaccggtcgtgtatatactgtctgatggcgcgaggaggcgatacg

SEQ ID NO: 793762 - DNA, 692 bp, Homo sapiens
  misc_feature: 71777.UNK.UNK.UNK.pb.heavy.1.raw 71777
cgtatcgctccctcgcgccatcagacagtatatacacgaccggtgcttcgattttagtagctctatcagggggagcatcacataacaaccacattcctcctctaaagaagcccctgggagcacagctcatcaccatggactggacctggaggttcctctttgtggtggcagcagcaacagggtccagtccctggtgcaactggtgcagtctggactagaattgccgcaacttggtcctcggtgaccctttcctgcacggcctctggaagtactaccagttccactacttataccatcaacgggttgcgccaggcccctggacaagggcttgagtggatgggtggaatcatccctcttttggctcactcacctacgcacgagacttccggggcagaattacgattaccgcggacaagtccacagaacacagtctccatgacaatgagttctttgaaatccgacgaacggccgtctactactgtgcgagaggtccgtaccccaggctcgcatggagccttgagatctgggggcagggaaccctggtcattgtcacctcagcttccaccaagggcccatcggtcttccccctggcgccctgctccaggagcacctctgggggcacagcggccctgggctgcctggtcaaggactacttcctataactgtctgagcgggctggcaaaggcgcatag

SEQ ID NO: 793763 - DNA, 606 bp, Homo sapiens
  misc_feature: 71785.44.27.C05.1.pb.heavy.1.raw 71785
cgtatcgcctccctcgcgccatcagacagtatatacacgaccggtgctcgatttagacgcgatcgaagggtttgggctgagctggttttcctcgttgcctcttaagaggtgtcatgtgtcaggtgcaattcgtggagtctggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattcgacgcctgggccagggaaccctggtcaccgtctcctcggcctccaccaagggccatcggtcttcccctggcgccctgctccaggagcacctccgagagcacagcggccctggctgcctggtcaaggactacttcctatatactgtctgagcgggctggcaaggcgcatag

SEQ ID NO: 793764 - DNA, 682 bp, Homo sapiens
  misc_feature: 71820.44.53.E09.1.pb.heavy.1.raw 71820
cgtatcgcctccctcgcgccatcagacagtatatacacgaccggtgctcgatttagagagagtgtgttgagctctgggaagaggagccccagccttgggattcccaggtgttttcattcagtgatcaggactgaacacaggaggactcaccatgggagttgggctgagcctggattttccttgctgctattttaaaaaggtgtccagtgtgaggtgcagttggtgagtctgggggaggtttggtaaagcctggggagtcccttagactctcctgtgcagcctctggattcactttcagtaacgcctgatgacctgggtccgcaggctccagggaaggggctggagtgggttggccgtattagaaccaaagctgacggtgggacagcagactacgctgcacccgtgaaaggcagattcaccatctcaagagatgattcaaagatacggtgtctctggcagatgaacagcctgaacaccgaggaccaggccgtctattactgtctgggatgggttttcattcggccagggaaccctggtccaccgtctcctcagcctccaccagggccatcggtcttccccctggcgcctgctccagagcacctccgagagcacagcggccctgggctgcctggtccaaggactacttcctatatactgtctgagcggctggcaaggcgcatag

SEQ ID NO: 793765 - DNA, 727 bp, Homo sapiens
  misc_feature: 71838.44.33.C11.1.pb.heavy.1.raw 71838
cgtatcgcctccctcgcgccatcagacagtatatacacgaccggtgctcgatttagagtgagctcgttggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaaggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaaggaccacggtcgccgtctcctcagcctccaccaagggcccatcggtcttccccctggcaccctcctccaagagcacctctgggggcacagcggccctgggctgcctggtcaaggactacttcctatatactgtctgagcggctggcaaggcgcatag

SEQ ID NO: 793766 - DNA, 653 bp, Homo sapiens
  misc_feature: 71839.UNK.UNK.UNK.pb.heavy.1.raw 71839
ggaaggctgggcaggctatgcaccctggtccaggttcaaaaaagctgcggaaacccgctagcggccatcttggccactaggggtcccgcagattcatattgtcgttctagcatggcacaaatgctgcaaaacccagcttgcaatgcccacagcaagcggccaatcttttacgccacgttgaattgtttattacctgtggactggctatggcttgcaacgccactcgtaaaaaactagtaacttttgcggttaggggaaagttagacaaacccattactccacttcccggaaagttccaaactcattccaacacgaaataaaaagtaaactcaaacaccccaagcaggctatgtgggggggtgataggggtggattctatttcctatcccatcccctaggaatctcaattaagtttactagcgaggtttaaatgtctgtaagcgatccccgtcagtcctatcgcgcgcatcaaagacctggttggttgagccgtgcagtaagattcatcgataaagctgcgagtttaggtcatccccagaccgcatctggcgcctaaaacgttcagtggtagctaagggcgttcaccttccgaactgtctaaaaggcaatatgtcgttccttagcttccaagtccctagcaaagcgtgtcgggg

SEQ ID NO: 793767 - DNA, 729 bp, Homo sapiens
  misc_feature: 71852.44.86.H09.1.pb.heavy.1.raw 71852
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagaggctccccaacccaagtctatagcactaaatcgagcaccggtcgtgtatatactgtctgatggcgcgagggaggcgatacg

SEQ ID NO: 793768 - DNA, 655 bp, Homo sapiens
  misc_feature: 71861.44.86.H09.1.pb.heavy.1.raw 71861
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 793769 - DNA, 666 bp, Homo sapiens
  misc_feature: 71874.UNK.UNK.UNK.pb.heavy.1.raw 71874
ctatgcgccttgccagcccgctcagacagtatataggaagtagtccttgaccaggcagcccagggccgctgtgccccagaggtgctcttggaggagggtgccaggggaagacgatgggcccttgtggagctgaggagacggtgaccagggttccctggccccaggggtcgagccagttcgccccccgtctctactgtatcgataggaatctctcgcacaataatatacggccgtgtccgcggcggtcacagaagtcaattcagggagaactgttcttggacctgtctagtgacatggtgactcgactcttgagggcggggttgtagttggtgctgccactgttatagatgcgccaatccactccagtcccttcccggcggactgccgcagccaactccaataataactactgatgtaaccaccagagacattgcaggtgagggacaggtctccgaaggcttcacccgtcctggcccgactcctgcagctgcacctcggacacgacccatctggaggtgccacaggaggaggaagaaccacaggtgtttcatgttcttgtgcaggaggcccatgagtctcagaaagtatccccaaaacccaactatcgtgtgctaaatcgagcacggtcgtgtatatactgtctgatggcgcgagggaggcgatacg

SEQ ID NO: 793770 - DNA, 606 bp, Homo sapiens
  misc_feature: 71877.44.36.D03.1.pb.heavy.1.raw 71877
cgtatcgcctccctcgcgccatcagacagtatatacacgaccggtgctcgatttagctgcgtcacgatctctcttgggtcttgtcccaggtcaccttgaaggagtctggtcctgtgctggtgaaaacccacagagaccctcacgctgacctgcaccatctctggttctctctcaacgatattagaatggtgtgagctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793771 - DNA, 646 bp, Homo sapiens
  misc_feature: 71890.44.19.B08.1.pb.heavy.1.raw 71890
cgtatcgcctccctcgcgccatcagacagtatatacacgaccggtgctcgatttagtgagtcagtaagggggactcctgtgccccaccatggacacactttgctccacgctcctgctgctgaccatcctcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtcctttctctgacgaccagactcacgctcacgaaggacacgtccaaaaaaccaggtggtccttacattgaccaacgtggaccctgtggacacaggcacatatttctgtgcccacttcatgaccacaatgaccacgggctttcttcgaaccctgggggccagggaatccaggtcaccgtctcatcagcctccaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 793772 - DNA, 616 bp, Homo sapiens
  misc_feature: 71912.44.23.C01.1.pb.heavy.1.raw 71912
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaaaatgatcagaactgatggaaactccagagacagtgcagatgagagacagggttcccgaaggcctcaccagtcctggcccgactcctgcagctgcacctgggacaggacccatctgggagctgccaccagcaggaggaaaaaccacaggtgttcaccctgcccaatccctaatcacgtgtactaaatcgagcaccggtcgtgtatatactgtctgatggcgcgagggaggcgatacg

SEQ ID NO: 793773 - DNA, 652 bp, Homo sapiens
  misc_feature: 71933.44.86.H09.1.pb.heavy.1.raw 71933
ctatgcgccttgccagcccgctcagacagttataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactcattcccctccctgggggctgccggatccagccccagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 793774 - DNA, 696 bp, Homo sapiens
  misc_feature: 71939.UNK.UNK.UNK.pb.heavy.1.raw 71939
ctatgcgccttgccagcccgctcagacagtatataggaagtagtccttgaccaggcagcccagggccgctgtgctctcggaggtgctcctggagcagggcgccagggggaagaccgatggcccttggtggaggctgaggagacggtgaccaggggttccctggcccagtggacagttcctgatataaacacacacaataatactgccgtgtcctcggtttcagggttagtcattcgcagaatcaatgagttcttgaagtcatcctcttgagagggggaatctggctttcacagacgcggcgtactctgtgataaagctggcaactttggtttttactgcggccaagccactccagccccttccctggagcctggcggacccagtccatatagtggtcactgatggtgaatcccagaggcgacacaggagagtctcagggaccctccaggctggaccaagtctcccccggactccaccaactgcacttcactctgggacaccttgtaaaataacaacaaggaaaacccagctcagcccgaactccatggtgagtcctctgtgttcagtgctgatcaccaaatgaaacacctggaattctggggctggggctccgctctcccccaagagagatcgtgacgcagctaaatcgagcacggtcgtgtatatactgtctgatggcgcgagggaggcgatacg

SEQ ID NO: 793775 - DNA, 700 bp, Homo sapiens
  misc_feature: 71978.44.36.D03.1.pb.heavy.1.raw 71978
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtgaagccagattcaccctctcaagagatgacttcaagaactcattgattctgcgaatgactaacctgaaaccgaggacacgggcatgtattattgtgttgtgtttatatcaggaactgtccactggggccagggaaccctggtcaccgtctcctcagcctccacaagggcccatcggtcttccccctggcgccctgctccaggagcacctccgagagcacagcggcctgggctgcctggtcaaggactacttcctatatactgtctgagcgggctggcaaggcgcatag

SEQ ID NO: 793776 - DNA, 604 bp, Homo sapiens
  misc_feature: 72032.UNK.UNK.UNK.pb.heavy.1.raw 72032
cccgacacgcttgctagggacttggcagctaaggacgacatattgcctttagaccagtcgaaggtgacgccttagctaccactgaacgtttaggcgccagatgcggtctgggatgacctaactcgcagcttatcgatgatctactgcacgctcaaccaaccaggtcttgatgcgcgcgataggactgacggatcgctacagacatttaactcgctagtaacttaattgagatcctagggatgggatagaaatagaatccacccctatcaccccccacatagcctgcttggggtgttgagtttacttttatttcgtgttggaatgagttgaacttccgggaagtggagtaatgggttttgtctacttcccctaaccgcaaagtactagttttacgagtggcgttgcagccatagccagtcacaggtaataaacaattcaacgtggcgtaaagattggcccgcttgctgtgggcattgcagcgggtttggcagcattgtgcatgctagacgacaatatgaatctgcggacccctagtgggccgatggccgctgcgggtttccgcagcttttgacctggaccagggtgcatagcctgcccagccttc

SEQ ID NO: 793777 - DNA, 607 bp, Homo sapiens
  misc_feature: 72055.44.36.D03.1.pb.heavy.1.raw 72055
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaacagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 793778 - DNA, 703 bp, Homo sapiens
  misc_feature: 72059.44.55.E11.1.pb.heavy.1.raw 72059
ctatgcgcctgccagcccgctcagacagtatataggaagtagtccttgaccaggcagcccagggccgctgtgccccagaggtgctcttggaggagggtgccagggggaagaccgatgggccccttggtggaggcgggaggcgacggtgaccagggttccctggccccagaagtcaaacgaataataaccactccgagcgccgacttgtctcgcacagtaatagacggcgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttcctggagcctggcggacccaactcatgtagttgctgctgacggtgagcccagaggcctgcacaggagagtctctgggaccgccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 793779 - DNA, 691 bp, Homo sapiens
  misc_feature: 72063.44.72.G06.1.pb.heavy.1.raw 72063
cgtatcgcctccctcgcgccatcagacagtatatacacgaccggtgctcgatttagctacgactgcaagggaaagggagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggcttggtccagcctgggggtccctgagactctcctgtgcagcctctggattcacctttagtagttattggatgaactgggtccgccaggctccagggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagccttccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 793780 - DNA, 571 bp, Homo sapiens
  misc_feature: 72065.44.78.H01.1.pb.heavy.1.raw 72065
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttccctggcccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 793781 - DNA, 625 bp, Homo sapiens
  misc_feature: 72070.UNK.UNK.UNK.pb.heavy.1.raw 72070
gagaaggctggaggctatgcaccctggttccaggttcaaaagctgcggaaccccgctagcggccatcttggccactaggggtccgcagatcatattgtcggtctagccatgcaccaatgctgcaacccagcttgcaaatgcccacagcaagcggccccaatctttacgccacgttgaattgtttattacctgtgacctggctatggcttgcaacgcccatcgtaaaactagtactttgcggttaggggaagtagacaaaccattactcccacttccggaagttcaactcattccaacacgaaataaaagtaaactcaacaccccaagcaggctatgtgggggggtgataggggtggattcctatttcctatcccatcccctaggatctcaattaagttactagcgagttaaaatgtctgtagcgatccgtcagtcctatcgcgcgcatcaagacctggttggtttgagcgtggcagtagattcatcgaataagctgcgagttaggtcatcccagaccgcatctggccgcctaaacttcagtggtagctaaggcgtcacccttcgacctgtctaaaggcaatatgtcgtccttaggctccaagtccctagcaagccgtggtccggg

SEQ ID NO: 793782 - DNA, 703 bp, Homo sapiens
  misc_feature: 72094.44.36.D03.1.pb.heavy.1.raw 72094
cgtatcgcctccctcgcgccatcagacagtatatacacgaccggtgctcgatttagctgcgtcacgatctctcttgggagctctgagagcggagccccaggccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccaggaaggggctggagtgcttggccgcagtaaaaacaaagttgccagctttatcacagagtacgccgacgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaaggggccatcggtcttccccctggcgccctgctccaggagcacctccgagagcacagcggccctgggctgcctggtcaaggactacttcctatatactgtctgagcggctggcaaggcgcatag

SEQ ID NO: 793783 - DNA, 695 bp, Homo sapiens
  misc_feature: 72095.44.27.C05.1.pb.heavy.1.raw 72095
cgtatcgcctccctcgcggccatcagacagtatataccacgaccggtgctcgatttagacgcgatcgaagggtttggggggaagaggaagtccgccggtgtttccactcggtgatcatcactgaacacagaggactcaccatggagttttgggctgagctgggttttccctcgtttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcggggctggcaaggccatag

SEQ ID NO: 793784 - DNA, 649 bp, Homo sapiens
  misc_feature: 72096.UNK.UNK.UNK.pb.heavy.1.raw 72096
ctatgcgccttgccagcccgctcagacagtatataggaagtagtccttgaccagcagcccaggcccgctgtgcccccagaggtgctcctgggcagggcgccagggggaagaccgatgggcccttggtggaagctgaggagacagtgcagggtgccacggccccatagattgaaagacagtctcgcctcgcacagaaataaaacggccgtgtccgcggcggtcacggaggtcagtttcagggagaagcggttcatggacgtgtccctcgaaatggtgagacgactcttgagggacggagagtagtacgtcgcccagtataatggatgtcaccatccactccattcccctccctgggggctgccggatccagccccaagaatgatcagaactgatggaaactccagagacagtgcagatgagagacagggtcccgaaggcctcaccagtcctgggccgactcctgcagctgcacctgggacaggaccatctgggagctgccaccagcaggaggaaaaaccacaggtgcttcatgttcttgcaacaggaggtccttgactctcagaaaagcatccccaaacccaagtctatagcactaaatcgaggcaccggtcgtgtatatactgtctgatggcgcgagggaggcgatacg

SEQ ID NO: 793785 - DNA, 683 bp, Homo sapiens
  misc_feature: 72105.UNK.UNK.UNK.pb.heavy.1.raw 72105
ctatgcgccttgccagcccgctcagacagtatataggaagtagtccttgaccaggcagcccagggccgctgtgctctcgaggtgctcctggagcagggcgccaggggaagaccgatgggcccttgtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggcccttcacagagtccacatagtgtgtctcagttccatcttcttcatgatggccacccactccagccccttccctggagcctggcggacccagttcatccaataactactaaagtgaatccagaggctgcacaggagagtctcaggaccccccaggctggaccaagctcccccagactccaccagttgcacctcacactggacaccttctaaaatagcaacaaggaaaacccagctcagtcccaattccatggtgagtcctctgtgctcagtgctgatcaccaagtggaaaggcttggagtccagggctaaggctcctctctcccctttcccttgcagtcgtagctaaatcgagcacggtcgtgtatatactgtctgatggcgcgaggaggcgatacg

SEQ ID NO: 793786 - DNA, 652 bp, Homo sapiens
  misc_feature: 72112.44.86.H09.1.pb.heavy.1.raw 72112
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatagtctgatggcgcgagggaggcgatacg

SEQ ID NO: 793787 - DNA, 740 bp, Homo sapiens
  misc_feature: 72132.UNK.UNK.UNK.pb.heavy.1.raw 72132
ctatgcgccttgccagcccgctcagaccagtatataggaagtagtccttgaccaggcagcccagggccgctgtgcccccagaggtgctcgttggagacggagggtgccaggggggaagaccgatgggcccttggtggaggcctgaggagacggtgaccgtggtcccttggccccagacgtccataccgtagtagtagtccccagcaggtggtagtactacaatatgtcctcgcacagtaatacacagccgtgtcctcgggctctcaggctgttcatttgcagatacagcgtgttcttggaattgtctctggagatggtgaatcggcccttcacggagtctgcatagtatttattacttccatcataccatataagtggccacccactccagcccccttgcctggagcctgggcggaccccagtgcatgccataggtactgaaggtgaatccagacgctgcacaggagagtctcagggacctcccaggctggaccacgcctcccccagactccaccagctgcacctgacactggacacctcttaaaagagcaacgaggaaaacccagctcagcccaaactccatggtgagtcctcctgtgttcagtgctgatcaccgaatggaaaacaccgcggccgacttctagtgctgggctcctctgccccccccgcgactgagtgatactaatcgagcaccgccgtcgtgtatatactgtctgatggcgcgaggggagggcgatacg

SEQ ID NO: 793788 - DNA, 543 bp, Homo sapiens
  misc_feature: 72137.UNK.UNK.UNK.pb.heavy.1.raw 72137
ctatgcgcctgccagccgctcagacagtataataggaagtagtccttgaccaggcagcccagggccgctgtgccccagagggctcctggagcagggcgccaggggaagaccgatgggcccttggtggaagctgaggagacggtgaccagggttccctggcccaggggtcgaaccacctccccgacgagctgctatacttccgggatctcgcacagtaatacacgccgtgtcctcagatctcaggctgctcagctccatgtaggctgtgttatggaggtgttcctggtcatggtgactctgccctggaacttctgtgcatagcctgtgttaccactgttagggttcatccatcccatccactcaagcccttgtcagtggcctgtcgcacccagtgatatcataattggtgaagtgtatccagaagccttgcaggagaccttcactgagcgccccaggcttcttcacctcagccccttactgctagtcccaaatcgagcaccggtcgtggtatatactgtctgatggcgcgagggaggcgatacg

SEQ ID NO: 793789 - DNA, 693 bp, Homo sapiens
  misc_feature: 72138.44.78.H01.1.pb.heavy.1.raw 72138
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggcccgaatgaaaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctgggaatcccaaggctggggctcctctcccagagctccccaaacccaaactactcacactaaatcgagcaccggtcgtgtatatactgtctgatggcgcgagggaggcgatacg

SEQ ID NO: 793790 - DNA, 691 bp, Homo sapiens
  misc_feature: 72141.UNK.UNK.UNK.pb.heavy.1.raw 72141
cgtatcgcctccgctcgcgccatcagacagtatatacagcgaccggtgcccgactttagtgtgagtagtttgggtttgggagcctctgagaggagccccggccttgggattcccaggtgttttcattcagtgatcgactgaacacagaggactcaccatggagtttgggctgagctggattttccttgctgctattttaaaggtgtccagtgtgaggtggcagttggtggagtctgggggaaggtttggtaaagccctggggagtcccttagactccctgtgcaggcctctggatttcactttcagtaaccgcctggatgacctgggtccgccaggctccagggaagggggctggagtgggttggccgtattagaccaaagcgacggtgggacagcagactacgctgcacccgtgaaaggcagattcaccatctcaagagatgattcaaagatacggtgtctctgcagatgaacagcctgaacacggaggacacaggccgtctattactgtctggatggtttcattcgggccagggaaccctggtcaccgtctcctcagcctccacaagggcccatcgtcttccctggcgccctgctccaggagcacctccgagagcacagcggccctggggctgcctggtcaagactacttcctatatacctgtctgaggcgggctggcaaggcgcatag

SEQ ID NO: 793791 - DNA, 695 bp, Homo sapiens
  misc_feature: 72145.44.53.E09.1.pb.heavy.1.raw 72145
cgtatcgcctccctcgcggccatcagacagtatatacacgaccggtgctcgatttagagagagtgtgttgagctctgggagaggagccccagccttgggattccccaggtgttttcattcagtgattcaggactgaacacagaggactcaccatggagtttgggctgagctggattttccttgctgcattttaaaaggtgtccagtgtgaggtgcagttggtggagtctgggggaggtttggtaaagccctggggagtccctttagactctcctgtgcagcctctggatttcactttcagtaacgcctggatgacctgggtccgccaggcctccagggaaggggctggaagtgggttggccgtattagaaccaaagctgacggtgggaacagcagactacgctgcacccgtgaaaggcagattccaccatctcaagagatgattcaaaagatacggtgtctctgcagatgaacagcctgaacaccgaggacacagccgtctattactgtcctgggatggtttcattcgggccagggaaccctggtcaccgtctcctcagcctccaccaaggggcccatcggtcttcccccctggcgccctgctccagggagcacctccgagagcacagcggccctggctgcctggtcaaggactacttcctatatactgtctgagcgggctggcaaggcgcatag

SEQ ID NO: 793792 - DNA, 716 bp, Homo sapiens
  misc_feature: 72155.44.85.H08.1.pb.heavy.1.raw 72155
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggtttcctcgttgctctttaagaggtgtccagtgtcaggtgcagctggtggagtctggggaggcgtggtccagcctgggaggtccctgagactctcctgtgcagcgtctggattcaccttcagtacctatggcatgcactgggtccgccaggctccaggcaagggctggagtgggtggcacttatatggtatgatggaagtaataaatactatgcagactccgtgaagggcgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggcctgggctgcctggtcaaggactacttcctatatactgtctgagcgggctggcaaggcgcatag

SEQ ID NO: 793793 - DNA, 600 bp, Homo sapiens
  misc_feature: 72170.UNK.UNK.UNK.pb.heavy.1.raw 72170
gaaggctggcaggctatgcaccctggtccaggtcaaaagctgcggaacccgctagcggccatcttggccactaggggtccgcagattcatattgtcgtctagcatgcacaatgctgcaaacccagcttgcaatgccacagcaagcggccaatctttacgccacgttgaattgtttattacctgtgactggctatggcttgcaacgccactcgtaaaactagtactttgcgttaggggaagtagacaaacccattactccacttcccggaagttcaactcattccaacacgaaataaaagtaaactcaacaccccaagcaggctatgtgggggtgataggggtggattctattttcctatcccatcccctaggatctcaattaagttactagcgagttaaatgtctgtagcgatccgtcagtcctatcgcgcgcatcaagacctggttggttgagcgtgcagtagatcatcgataagctgcgagttaggtcatcccagaccgcatctggcgcctaaacgttcagtgtagctaaggcgtcaccttcgactgtctaaaggcaatatgtcgtccttagctccaagtcctagcaagcgtgtcggg

SEQ ID NO: 793794 - DNA, 682 bp, Homo sapiens
  misc_feature: 72176.44.53.E09.1.pb.heavy.1.raw 72176
cgtatcgcctcctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggatttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctaagcgggctggcaagcgcgcatag

SEQ ID NO: 793795 - DNA, 653 bp, Homo sapiens
  misc_feature: 72260.44.86.H09.1.pb.heavy.1.raw 72260
cgtatcgcctccctcgcgccatcagacagtatatacacgaccggtgctcgatttagtgctatagacttgggtttggggatgcttttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 793796 - DNA, 548 bp, Homo sapiens
  misc_feature: 72277.44.27.C05.1.pb.heavy.1.raw 72277
cgtatcgcctccctcgcgcgccatcagacagtatatacacgaccggtgctcgatttagacgcgatcgaaggggtttggggaggcgtggccccagtagggggtccctgagactctcctgtgcagcctctggattcaccttcgataattggaatatgcagtgggtccgccaggctccaggcgaggggctggagtgcgtggcaggtgtgtcatttcatggaggaaatcaagtctacggtgattccgttgagggccgattcaccatctccagagacaattcccgagaacacagtgtctcttcaaaatgaacagcctgagacctcaggacaccggccgtgtatttttgtgcgagactatctgtttccaaaatcggttcattcgacgcctgggccagggaaccctggtcaccgtctctcggtccaccaagggcccatcggtcttcccctggcgccctgctccaggagcacctccgagagcacagcggccctgggctgcctggtccaaggactacttcctatatactgtctgagcgggctgcaaaggccgcatag

SEQ ID NO: 793797 - DNA, 656 bp, Homo sapiens
  misc_feature: 72294.UNK.UNK.UNK.pb.heavy.1.raw 72294
ctatgcgccttgccagcccgctcagacagtatataggaagtagtccttgaccaggcagccaggccgctgtgctctcggaggtgctcctgggcaggcgccaggggaagaccgatggccttggtggagctgaagagacgtgaccattgtccttgcgcccagatatcaaagccactcacataaccacacttttataatagttgatcatgtgtgcgcagtagtatgtggctgtgtccgcagggccatgttggcccactctaaggatcacctgcgtattggggcgtctccggtgatggagagtctgctcttcagagatggactgtagcgcctatcatcatcccaataaatgagtgcaagccactccagggcctttcctggggggctgacggacccagcccacaatcgctccatcactcctgagtgagaacccagagaggttgcaggtcagcgtgagggtctgtgtgggcttcaccagcgtaggaccagactccttcaaggtgatctgggacaagacccatgaagggatggtcagcagcaggagcgtgagcaaagtgtgtccatggtggggcacaggagtcccccctttccctcgtagcacgtctaaatcgagcaccggtcgtgggtgtatactgtctgatggcgcgagggagggcgatacg

SEQ ID NO: 793798 - DNA, 703 bp, Homo sapiens
  misc_feature: 72310.44.36.D03.1.pb.heavy.1.raw 72310
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttgcgtccagcctggagggtccctgagactctcctgtgtcgcctctggattcaccatcagtgaccactatatggactgggtccgccaggctccagggaaggggctggagtggcttggccgcagtaaaaacaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcgtcttccccctggcgccctgctccaggagcacctcgagagcacagcggccctgggctgcctggtcaaggactacttcctatatactgtctgagcgggctggcaaggcgcatag

SEQ ID NO: 793799 - DNA, 684 bp, Homo sapiens
  misc_feature: 72352.44.45.E01.1.pb.heavy.1.raw 72352
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 793800 - DNA, 701 bp, Homo sapiens
  misc_feature: 72356.44.36.D03.1.pb.heavy.1.raw 72356
cgtatcgcctcctcgcgcatcagacagtatatacacgaccggtgctcgatttagctgcgtcacgatctctcttggggagctctgagagcggaagccccagccccagaattcccaggtgttttcatttgggtgatcagcactgaacacagaggaactcaccatggagttcgggcctgagctgggttttccttgttgttattttacaaggtgtccagagtgaagtgcagttggtgggagtcggggagacttggtccagcctggagggtccctgagactctcctgtgtcgcctctgattcaccatcagtgaccactatatggactggtccgccaggctccagggaaggggctggagtggcttggcgcagtaaaaacaaagttgcccagctttatcacagaagtacgccgcgtccgtgaaagccagattcaccctctcaagagatgacttcaagaactcatgattctgcgaatgactaacctgaaaaccgaggacaccgggcatgtattattgtgttgttggtttatatcaggaactgtccactgggccagggaaccctggtcaccgtctcctccagctcccacaaggcccatcggtcttcccctggcgcctgctccaggagcacctccgagagcacagcggccctgggctgcctggtcaaggactacttcctatatactgtctgacgggctggcaaggcgcaag

SEQ ID NO: 793801 - DNA, 702 bp, Homo sapiens
  misc_feature: 72361.44.27.C05.1.pb.heavy.1.raw 72361
ctatgcgccttgccagcccgctcagacagtatataggaagtagtccttgaccaggcagcccagggccgctgtgctctcggaggtgctcctggagcagggcgccaggggaagacccgatgggcccttggtggaggcgaggagacggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacactgccacccactccagccccctcgcctggagcctggcggacccactgcatattccaattatcgaaggtgaatccagaggctgcacaggagagtctcagggaccccccctactggggccacgcctccccagactccacgaattgcacctgaacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 793802 - DNA, 569 bp, Homo sapiens
  misc_feature: 72367.44.78.H01.1.pb.heavy.1.raw 72367
ctatgcgccttgccagcccgctcagacagtatataggaagtagtccttgaccaggcagcccagggccgctgtgctctcgaggtgctcctggagcagggcgccaggggaagaccgatgggcccttggtggagctgaggagacggtgaccagggttccctggccccacaagtcaagccagggtgctggtggctctcgcacagaaatacacggccgtgtcctcagatctcaggctgctcagttccatgtagactgtacctggggagtgctcctggtcatactaactctgccttggaacttctgggcaaagcccgtgttgccactatagggcttcatccatcccatccactccagcccttgtccagcggcccgtcgcacccagttaatatcataattgatgaacgtggtatccagaagccgtgcaggagactgtcactgaggccccaggcttcttcacctcagcagcgtggtgaccgtgacctccagcaacttcggcacccaaaccaaactactcacactaaatcgagcaccggtcgtgtatatactgtctgatggcgcgaggaggcgatacg

SEQ ID NO: 793803 - DNA, 704 bp, Homo sapiens
  misc_feature: 72368.44.55.E11.1.pb.heavy.1.raw 72368
cgtatcgcctccctcgcgccatcagacagtatatacacgaccggtgctcgatttagcactcgcacgttgggtttgggggggagaggagcccagcactggattccgaggtgtttccattcggtgatcagcactgaacacagaggactcaccatggagttttggcctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggttcttcccctggcaccctccttccaagagcacctctgggggcacagcggccctgggctgcctggtcaaggactacttcctatatactgtctgagcggctggcaaggcgcatag

SEQ ID NO: 793804 - DNA, 703 bp, Homo sapiens
  misc_feature: 72373.44.33.C11.1.pb.heavy.1.raw 72373
cgtatcgcctccctcgcgccatcagacagtatatacacgaccggtgctcgattagagtgagctcgttggtttgggagctctggagaggagccagcaccagagtcggcggtgtttccagtcggtgatcagcaccgaacacagaggactcaccatggagttgggctgactgggtttcctcgttgctcttttaagaggtgtccagtgtcaggtgaagctggtggagtctggggaggcgtggtccagctggaggtccctgagactctcctgtgtagcgtctggattcaccttcaacagacatgcatgcactgggtccgccaggctccaggcaagggactggagtgggtggcacttatatggtatgatggaagtaataaatattatgtagatccctgaagggccgattcaccatctcagagacaattcgaagaacacactatatctggaaatgaatagcctgagagcgagacacggctgtctactactgtgcgagagatgggctcgtggatacagatatgacatgctctactccaatggtatggacgcctgggccaaggaccacggtcgcgtctcctcagctccaccaagggcccatcggtcttcccctggcacctcctccaagagcactctggggcacagcggccctgggctgcctggtcaaggactacttcctatatactgtctgagcgggctggcaggcgcatag

SEQ ID NO: 793805 - DNA, 717 bp, Homo sapiens
  misc_feature: 72380.UNK.UNK.UNK.pb.heavy.1.raw 72380
cgtatcgcctccctcgcgccatcagacgtatatacacgacggtgctcgatttagcagacgtctgaacacacaaagggggagctctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggaagtcggggggggggcttggtacagccagggcggtctctggactctccctgtgtagtctcaggattcagtcttagtgattatcacttggcctgggtccgtcaggctccagggaaggggcttgagtggatcactttcgtcagatgaacgttatggtggaagtaaagagtacgccgcgtctgtgaagggaagattcaccgtctcagggatgactccaacagtgttggccatttacaaatgagcaacctgagacccgacgacacaggcgtctattactgcgcgccaggcgatcctgggacgtcgatgcatttgaatattttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793806 - DNA, 692 bp, Homo sapiens
  misc_feature: 72385.44.35.D02.1.pb.heavy.1.raw 72385
cgtatcgcctccctcgcgccatcagacagtatatacacgaccggtgctcgattttagcacacgatagttgggtttggggatactttctgagactcatgggcctcctgcacaagaacatgaaaacacctgtggttcttcctcctcctggtggcacctcccagatgggtcgtgtccgaggtgcagctgcaggagtcggggcccaggacgggtgaagccttcggagaccctgtccctcacctggcaatgtctctggtggtttacatcaagtagttattattggagttggctgcggcagtccgccgggaagggactggagtggattgggcgcatctataacagtggcagcaccaactacaaacccgccctcaagagtcgagtcaccatgtcactagaccaggtccaagaaccagttctccctgaaattgacttctgtgacccgccgcggacacggccgtatattattgtgcgagagattcctatcgatacagtagagacgggggggcgaaactggcttcgacccctggggccagggaaacctggtcaccgtctcctcagcctccaccaagggcccatcggtcttccccctggcaccctcctccaaagagcacctctgggggcacagcggccctgggctgcctggtcaaggactactttcctatatactgtctgagcgggctggcaaaggcgcatag

SEQ ID NO: 793807 - DNA, 569 bp, Homo sapiens
  misc_feature: 72393.44.53.E09.1.pb.heavy.1.raw 72393
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgacgtccccctgccccagacatccatcaaatagtagtagtttatgattccccgaaccgtttccttggaggtccccctcgcacagtaataaacagacgtgtcgtcaactctcacgctgttcatttgcaaatacagcatattcttggaattgtctctggagatggtgaatcggcccttcacggagtctgagtaatacttctcacttccatcgtcggagatgactgccacccactcggcccttgcctggagcctggcggacccagtgcaaaccaaatctatcgaatgagaacccagagctacacaggagagtctcagggacctcccgggctggaccacgcctcccccaaacccaacacactctctctaaatcgagcaccggtcgtgtatatactgtctgatggcgcgagggaggcgatacg

SEQ ID NO: 793808 - DNA, 688 bp, Homo sapiens
  misc_feature: 72394.44.55.E11.1.pb.heavy.1.raw 72394
cgtatcgcctccctcgcgccatcagacagtatatacacgaccggtgctcgatttagcactcgcacgttgggtttggggagaggagcccagcactgggattccgaggtgtttccattcggtgatcagcactgacacagaggactcaccatggagttttggctgagctggttctccttgttggacttttaaaaggtgtccagtgtgagtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactcgtgaagggccgattcaccatctccagggacaattccaggaacacggtttatcttcaaatgaacaacctgagaggcgacgacacggccgtctattactgtgcgagacaagtcggcgctcgagtggttattattcgtttgacttctgggcaggaaccctggtcaccgtcgctcgctccaccaagggcccatcggtcttccctggcaccctcctccaagagcactctgggggcacagcggccctgggctgcctggtcaaggactacttcctatatactgtctgagcggctggcaaggcgcatag

SEQ ID NO: 793809 - DNA, 613 bp, Homo sapiens
  misc_feature: 72407.44.23.C01.1.pb.heavy.1.raw 72407
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagatgaaagaccagtctcgcctcgcacagaaataaacggccgtgtccgcggcggtcacggaggtcagtttcagggagaagcggttcatggacgtgtccctcgaatggtgagacgactcttgaggacggagagtagtacgtcgccccagtataatggatgtcaccaatccactccattccctccctggggctgccggatccagccccaagaatgatcagaactgatggaaactccagagacagtgcagatgagagacaggttccgaaggcctcaccagtcctgggcccgactcctgcagctgcacctgggacaggacccatctgggagctgccaccagcaggaggaaaaaccacaggtgttcaccctgccccaatccctaatcacgtgtactaaatcgagcaccggtcgtgtatatactgtctgatggcgcgaggaggcgatacg

SEQ ID NO: 793810 - DNA, 614 bp, Homo sapiens
  misc_feature: 72418.UNK.UNK.UNK.pb.heavy.1.raw 72418
gaaggctgggcaggctatgcaccctggtccaggtcaaaagctgcggaacccgctagcggccatcttggccactagggtcccgcagattcatattgtcgtctagcatgcacaatgctgcaaacccagcttgcaatgcccacagcaagcggccaatctttacgccacgttgaattgtttatttacctgtgactggctatggcttgcaaccgccactcgtaaaactagtacttttgcggttaggggaagtagacaaaccattactccacttcccggaagttcaactcattccaacacgaaataaaagtaaactcaacaccccaagcccaggctatgtggggggtgataggggtggattgctatttcctatcccatccctaggatctcaattaaggttactagcggagttaatgtctgtagcgatcccgtcagtcctatcgcgcgcatcaagacctggttggttgagcgtgcagtagatcatcgataagctgccgagttaggtcatcccagaccgcatctggcgcctaaacgttcagtggtagctaaggcgtcaccttcgactggtctaaaggcaatatgtcgtccttagctccaagtcccctagcaagcgtgtcggg

SEQ ID NO: 793811 - DNA, 711 bp, Homo sapiens
  misc_feature: 72425.44.56.F01.1.pb.heavy.1.raw 72425
ctatgcgccttgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccgactccgccagtcgcccctcgcactggacaccttctaaaaaaactacaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 793812 - DNA, 694 bp, Homo sapiens
  misc_feature: 72436.44.27.C05.1.pb.heavy.1.raw 72436
ctatgcgccttgccagcccgctcagacagtatataggaagtagtccttgacaggcagccagggccgctgtgctctcggaggtgctcctggagcagggcgccaggggaagaccgatggcccttggtggaggccgaggagacgggtgaccagggttccctggccccaggcgtcgaatgaaccgatttggaaacagatagtctcgcacaaaaatacacggccgtgtcctgaggtctcaggctgttcatttgaagagacactgtgttctcggaattgtctctggagatggtgaatcggccctcaacggaatcaccgtagacttgattcctccatgaaatgacacacctgccacccactccagcccctcgcctggagcctggcggaccactgcatattccaattatcgaaggtgaatcagaggctgcacaggagagtctcaggacccccctactggggccacgcctcccccagactccacgaattgcaccctgacacatgacacctctaagagggcaacgaggaaaacccagctcagcccaaactccatggtgagtcctctgtgttcagtgatgatcaccgagtggaaacaccggcgacttccagtgctgggctcgtctcccagccccaaaccttcgatcgcgtctaaatcgagcaccggtcgtgtatatactgtctgatggcgcgaggaggcgatacg

SEQ ID NO: 793813 - DNA, 661 bp, Homo sapiens
  misc_feature: 72458.44.12.B01.1.pb.heavy.1.raw 72458
cgtatcgcctccctcgcgccatcagacagtatatacacgaccggtgctcgatttagtagtgtagattccgcgggggctttctgagagtcatggacctcctgtgcaagaacatgaagcacctgtggttctttcctcctgctggtggcggctccagatgggtcctgtcccagctgcagctgcaggagtcgggcccaggactggtgaagccttcggagaccctgtccctcacctgcactgtctctggtggctccatcagcagtagtagttactactggggctggatccgccagccccagggaaggggctggagtggattgggagtatctattatagtgggagcacctactacaacccgtccctcaagagtcgagtcaccatatcagtagacacgtcaagaaccagttctcctgaagctgagctctgtgaccgccgcggacacggccgtgtattactgtgcgagagtagggcagttcgtcaccaactactttgaccactgggccagggaaaccctggtcaccgtctcctcagcctccaccaagggcccatcggtcttccccctggcacctcctccaagagcacctctgggggcacagcggccctgggctgcctggtcaaggactacttcctatatactgtctgagcgggctggcaaggcgcatag

SEQ ID NO: 793814 - DNA, 679 bp, Homo sapiens
  misc_feature: 72502.44.19.B08.1.pb.heavy.1.raw 72502
cgtatcgccctcctcgcgccatcagaccagtatataccacgaccggtgctcgatttagtgagtcagtagggaaagggctgggagaggagccagcactagaagtcggcggtgtttccattcgctgatcagcactgaacacagaggactcaccatggagtttgggcctggagctgggttttcctcgttgctctttaagaggtgtcagtgtcaggtcagctggtggagtctgggagcgtgccaggcctggacgtcctgagactctccgtgttgcgtccggactcagtttcgtgactctgccatgcactgggtccgccaggctccaggcaggggctggagtgggggtgcagtcatctgtctgatggaagtaaagaatactatggaaactcctgaaggcgccgattctccggctcccagagacaattccaagaacaccgtgtatctacacaatgaacaatttgagagccgagactcccgctctctgattattgtacgagcccatcgttcactggcggccagggcggagccctggtcaccgtctctcagcctccaccaagggcccatcgcttccccctgggcgccctgctccaggggcacctccgagagcacagcgggccctggcgctgcctggtcaaggactacttcctatatacctgtctgagcgggcctggcaggcgcatag

SEQ ID NO: 793815 - DNA, 696 bp, Homo sapiens
  misc_feature: 72508.44.36.D03.1.pb.heavy.1.raw 72508
ctatgcgccttgccagcccgctcagacagtatataggaagtagtccttgaccaggcagccagggccgctgtgctctcggaggtgctcctggagcagggcgccagggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctggggctggggctccgctctcccccaagagagatcgtgacgcagctaaatcgagcaccggtcgtgtatatactgtctgatggcgcgagggaggcgatacg

SEQ ID NO: 793816 - DNA, 689 bp, Homo sapiens
  misc_feature: 72527.UNK.UNK.UNK.pb.heavy.1.raw 72527
ctatgcgccttgccagccgctcagacagtatataggaagtagtccttgaccaggcagcccagggccgctgtgctctcggaggtgctcctggagcagggcgccaggggaagaccgatgggccttggtggaggccgaggagacggtgaccagggttccctggccccaggcgtcgaatgaaccgatttggaaacagatagtctcgcacaaaatacacggccgtgtcctgaggtctcaggctgttcatttgaagagacactgtgttctcggaattgtctctggagatgtgaatcggccctcaacggaatcaccgtagacttgatttcctccatgaaatgacacacctgccacccctccagccctcgcctggagcctggcggacccactgcatattccaattacgaaggtgaatccagaggctgccacaggagagtctcaggacccccctactggggccacgcctccccagactccacaattgcactgacacatgacacctcttaagagggcaacgaggaaaacccagctcagcccaaactccatggtgagtccctctgtgttcagtgatgatcaccgagtggaaacaccggcgacttccagtgctgggctcgtctcccagccccaacccttcgatcgcgttaatcgagcaccggtcgtgtatatactgtctgatggcggagggaggcgatacg

SEQ ID NO: 793817 - DNA, 665 bp, Homo sapiens
  misc_feature: 72529.44.12.B01.1.pb.heavy.1.raw 72529
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaagggctggagtggattgggagtatctattatagtgggagcacctactacaacccgtccctcaagagtcgagtcaccatatcagtagacacgtccaagaaccagttctccctgaagctgagctctgtgaccgcccgcggacacggccgagtattactgtgcgagagtaggggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793818 - DNA, 707 bp, Homo sapiens
  misc_feature: 72556.44.55.E11.1.pb.heavy.1.raw 72556
cgtatcgcctccctcgcgccatcagacagtatatacacgaccggtgctcgatttagcactcgcacgtttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattattcgttttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793819 - DNA, 677 bp, Homo sapiens
  misc_feature: 72557.44.35.D02.1.pb.heavy.1.raw 72557
cgtatcgcctcctcgcgccatcagacagtatatacacgaccggtgctcgattttagcacacgatagttgggtttggggatactttctgagactcatgggcctcctgcacaagaacatgaaacacctgtggttcttcctcctcctggtgcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattctatcgatacagtagagacggggggggcgaaactggctcgacccctggggccagggaaccctggtcaccgtctcctcagcctccaccaagggcccatcggtcttccccctggcaccctcctccaagagcaactctggggcacagcggccctgggctgcctggtcaaggactacttcctatatactgtctgagcgggctggcaaggcgcatag

SEQ ID NO: 793820 - DNA, 701 bp, Homo sapiens
  misc_feature: 72564.44.27.C05.1.pb.heavy.1.raw 72564
cgtatcgcctccctcgcgccatcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgaggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 793821 - DNA, 674 bp, Homo sapiens
  misc_feature: 72586.UNK.UNK.UNK.pb.heavy.1.raw 72586
tatgcgccttgccagcccgctcagacagtatataggaagtagtccttgaccaggcagcccaggggccgctgtgcccccagaggtgctcctggagcagggcgccaggggaagaccgatgggcccttggtggaagctgaggagacggtgaccgtggtcccttggccccagacgtccataccgtagtagtagtatgcaactccccgaactccgcaccggctccttgcacagtaatacacagccgtgtcctcggcttctcagactgttcatttgcagatacagcgtgttttggcgttgtctctggagatggtgaatcggcccttcacggagtccggcgtagcttgtgctactcccatcactattaatacgtgagacccacaccagccccttccctggagcttggcggaccccagtgcattccagtagctactgaaaggtgaatccagaggctgcacaggagagtctcaggacccccccaggctgaactaagcctaccccatgcccacggtgcccagagcccaaatcttgtgacacacctccccgtgcccaaggtgcccagcacctgaaactcctgggaggacgcgtcagtcttcgctcttccccccaaacccaactatcagatactaaatcgagcacgtcgtgtatatactgtctgatggcgcgagggaggcgatacg

SEQ ID NO: 793822 - DNA, 717 bp, Homo sapiens
  misc_feature: 72595.44.36.D03.1.pb.heavy.1.raw 72595
cgtatcgcctccctcgcgccatcagacagtatatacacgaccggtgctcgatttagctgcgtcacgatctctcttggggagctcctgagagcggagccccagccccagaattcccaggtgttttcatttggtgaatcagcactgaacacagaggactcaccatggagttcgggctgagctgggtttccttttgttattttacaaggtgtccagagtgaagtgcagttggtggagtccgggggagacttggtccagcccctggagggtccctgaaggactctcctgtgtcgcctctggattcaccatcagtgaccactatatggactgggtccgccaggcctccagggaagggggctggagtggcttggccgcagtaaaaacaaagttgccagctttatcacagagtacggccgctctgtgaaaagccagattccaaccctctcaagagatgacctttcaagaactcattgattctgcgaatgactaacctgaaaaccgaggaccacgggcatgtattattgtgttgtgtttatatcaggaactgtccacttggggccagggaaccctggtcaccgtctcctcagccctccaccaagggcccatcggtcttcccctggcgcctgctccaggagcacctccgagagcacagcggccctgggctgcctggtcaaggactacttcctatatactgtctgagcgggctggcaaggcgcatag

SEQ ID NO: 793823 - DNA, 688 bp, Homo sapiens
  misc_feature: 72616.UNK.UNK.UNK.pb.heavy.1.raw 72616
cgtatcgcctccctcgcgccatcagacagtatatacacgaccggtggctcgatttagtagctctatcaggggagcatcacataacaaccacatcctcctctaaagagccctgggagcacagctcatcaccatggactggacctggaggtcctctttgtggtggcagcagcaacaggtgtccagtccctggtgcaactggtgcagtctgggactagaatgccgcaaaccttggtcctcggtgaccctttcctgcacggctctggaagtactaccagttccactacttataccatcactgggtgcgccaggcccctggaccaaggggcttgagtgggatgggtggaatcatccctctttttggctcactcacctacgcacgagacttccgggcagaattacgataccgcggacaaggtccacagacacagtctccatgacaatgagttcttttgaaatccgacgacacggccgtctactactgtgcgagaggtccgtacccccagctcgcatggagcctttgagatctggggcaggaaccctggtcattgtcacctcagcttccacaagggcccatcggtcttccccctggcgccctgctccaggagcacctctggggcacagcggccctgggctgcctggtcaaggatacttcctatatactgtctgagcgggctggcaaggcgcatag

SEQ ID NO: 793824 - DNA, 690 bp, Homo sapiens
  misc_feature: 72623.44.9.A09.1.pb.heavy.1.raw 72623
cgtatcgcctccctcgcgccatcagacagtatatacacgaccggtgctcgatttagcgagacgcgcagggggggagacgagcccagcactggaagtcgccggtggtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactcctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgccatctgcaaatgtacaacctcacaagtgaggacacggctgtctattattgtgcgagagcccctcgagacggtccccgcttgactactggggccagggaaccctggtcaccgtctcctcagcctccaccaagggcccatcggtcttcccctggcgcctgctccaggagcacctccgagagcacagcggccctggctgcctggtcaaggactacttcctatatactgtctgagcgggctggcaaggcgcatag

SEQ ID NO: 793825 - DNA, 702 bp, Homo sapiens
  misc_feature: 72631.44.67.G01.1.pb.heavy.1.raw 72631
cgtatcgcctcctcgcgccatcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 793826 - DNA, 721 bp, Homo sapiens
  misc_feature: 72662.44.36.D03.1.pb.heavy.1.raw 72662
ctatgcgccttgccagcccgctcagaacagtatataggaagtagtccttggaccaggcagcccagggccgctgtgctctcggaggtgctcctggagcagggcgccagggggaagaccgatgggcccttggtggaggctgaaggagacggtgaccagggttccccggccccagtagtccaaaaccagccactgaccaagtggcccgatcctctcgaaacagaagtagacagccgtgtctcgcctctcaggctgtttcatttccagatacagtgaaggtcttggcattgtccctggaattggtgaatcggcccttcacagagtctgcgtagtaggtgtatctccagcaatattaacatatgaaacccactccagccccttccctggagcctggcggacccagtttcatggcatagtccactgaaagatgaatccagaggctgcacaggagagtctcaggaccccccccgctgtaccaagccctccccagactccaccagccgcaacctcacagtggacaccttctaaaatagcaaacaaggaaaacccaagcgcagcccaactccatggtgagtcctctgtgttcagtgctgatcaccaagtgaatgccttggaatccagggctaaggcacctctctgagagcttcccaagagagatcgtgacgcagctaatcgagcaccggtcgtgtatatactgtctgatggcgcggagggaggcgatacg

SEQ ID NO: 793827 - DNA, 702 bp, Homo sapiens
  misc_feature: 72684.44.55.E11.1.pb.heavy.1.raw 72684
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgtggctgatggagtctggaggagcttagtccagcctgggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttttgacttctggggccagggaaccctggtcaaccgtcgcctccgcctccaccaagggcccatcgtcttcccctggcaccctcctccaagagcacctctgggggcacagcggccctgggctgcctggtcaaggactacttctatatactgtctgagcgggctggcaaggcgcatag

SEQ ID NO: 793828 - DNA, 634 bp, Homo sapiens
  misc_feature: 72695.44.86.H09.1.pb.heavy.1.raw 72695
cgtatcgcctccctccgcgcatcagacagtatatacacgaccggtgctcgatttagtgctatagacttggtttggggatgctttctgagagtcaggacctcctgtgcaagaacatgagcacctgtggtttttcctcctgctggtgcagctcccagatggtcctgtcccaggtgcagctgcaggagtcgggcccaggactggtgaggcctcggaaccctgtctctcatctgcactgtctctggagtttccatcagttctgatcattcttgggctggatccggcagccccagggaggggaatgggtgatggtgacatccattaactggggcgacgtactactctccgtcctcaagagtcgtctcaccatttcgagggacacgtccatgaaccgcttctccctgaaactgacctccgtgaccgccgcggacacggccgtttatttctgtgcgaggcgagactggtctttttcaatctatggggccgtgcacctggtcactgtctcctcagcttccaccaagggcccatcggtcttccctggcgcccgctccaggacacctctgggggcacagcggcctgggctgcctggtcaaggactacttcctatatactgtctgagcgggctgcaggcgcatag

SEQ ID NO: 793829 - DNA, 673 bp, Homo sapiens
  misc_feature: 72697.44.35.D02.1.pb.heavy.1.raw 72697
cgtatcgcctccctcgcgccatcagacagtatatacacgaccggtgctcgatttagcacacgatagttgggtttggggatactttctgagactcatgggcctcctgcacaagaacatgaaacacctgtggttcttctcctcctggtggcacctcccagatgggtcgtgtccgaggtgcagctgcaggagtcgggcccaggacgggtgaagccttcggagacctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcgaactggctcgacccctggggccagggaaccctggtcaccgtctcctcagcctccaccaaggcccatcggtcttccccctggcaccctcctccaagagcacctctggggcacagcgccctggctgcctggtcaggactacttcctatatactgtctgagcgggctggcaaggcgcatag

SEQ ID NO: 793830 - DNA, 708 bp, Homo sapiens
  misc_feature: 72707.44.67.G01.1.pb.heavy.1.raw 72707
ctatgcgccttgccagcccgctcagacagtatataggaagtagtcttgaccaggcagcccagggccgctgtgccccagaggtgctcttggaggaggggtgccagggggaagaccgatgggccccttggtggaggcggaggcgacggtgaccagggttccctggccccagaagtcaaacgaataataaccactccgagcgccgacttgtctcgcacagtaatagacggcccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcgggaatcccagtgctgggctcctctcccccccaaacccaatatgtatactctaaatcgagcaccggtcgtgtatatactgtctgatggcgcgaggggaggcgatacg

SEQ ID NO: 793831 - DNA, 731 bp, Homo sapiens
  misc_feature: 72751.44.86.H09.1.pb.heavy.1.raw 72751
cgtatcgcctccctcgcgccatcagacagtatatacacgaccggtgctcgatttagtgctatagacttgggttggggagctctgggagaggagcccagcaccagaagtcggcggtgtttccagtcggtgatcagcaccgaaacacagaggactcaccatggagtttggggctgacctgggttttcctcgttgctcttttaagaggtgtccagtgtcaggtgaagctggtggagtctggggaggcggtggtccagcctgggaaggtccctgagactctcctgtgtagcgtctggattcaccttcaaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaaggcccatcggtcttccccctggcaccctcctccaagagcacctctgggggcacagcggccctggctgcctggtcaaggactacttcctatatactgtctgagcgggctggcaaggcgcatag

SEQ ID NO: 793832 - DNA, 617 bp, Homo sapiens
  misc_feature: 72755.UNK.UNK.UNK.pb.heavy.1.raw 72755
ctatgcgccttgccagccgctcagacagtatataggaagtagtccttgaccaggcagcccaggccgctgtgcccccagaggtgctcctggagcagggcgccaggggaagaccgatgggcccttggtggaagctgaggagacggtgaccgtggtccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagaagtctcagggacccccccaggctgaactaagcctcccccggactccacagctgcacctcacactggacaccttttaaaatagcaacaaggaaaacccagctatcagatactaaatcgagcacccggtcgtgtatatactgtctgatggcgcgagggaggcgatacg

SEQ ID NO: 793833 - DNA, 686 bp, Homo sapiens
  misc_feature: 72759.44.38.D05.1.pb.heavy.1.raw 72759
ctatgcgccttgccagcccgctcagacagtatataggaagtagtccttgaccaggccagcccagggccgctgtgcccccagaggtgctcctggagcagggcgccaggggaagaccgatggcccttggtggaagctgaggagacggtgaccgtggtcccttggccccaagacgtccataccgtagtagtaggtatggcaactcccgaaactcccgcaccggctcttgcacagtaatacacagccgtgtcctcggctctcagactgttcatttgccagatacagcgtgttcttggcgttgtctctggagattggtgaatcggcccttcacggagtccggcgcgtaagcttgtgctactccatcactattaatacgttgagaacccacaccagccccttcctggagcttggccgacccagtgcatccagtaagctactgaaggtgaatccagaggctgcacaggagagtctcagggacccccaggctgaaactaagcctcccccatgccacggtgcccagagcccaaatcttgtgacacaacctcccccgtgcccaaggtgcccagcaacctgaactcctgggaggaccgtcagtcttcctcttccccccaaaacccaaactatcagatactaaaatcgagcaccggtcgtgtatatactgttctgatggcgcgaggagggcgatacga

SEQ ID NO: 793834 - DNA, 710 bp, Homo sapiens
  misc_feature: 72779.44.55.E11.1.pb.heavy.1.raw 72779
ccgtatcgcctccctcgcgccatcagacagtatatacacgaccggtgctcgatttagcactcgcacgttgggttttgggggggagaggagcccagcactgggattccgaggtgtttccattcggtgatcagcactgaacacagaggactcaccatggagtttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggggaagggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtccggcgctcggagtggttattattcgtttgacttctgggccagggaaccctggtcaccgtcgcctccgcctccaccaagggcccatcggtcttccccctggccaccctcctccaagagcacctctgggggcacagcggccctgggctgcctggtcaaggactacttcctatatactgtctgagcgggctggcaaggcgcatag

SEQ ID NO: 793835 - DNA, 734 bp, Homo sapiens
  misc_feature: 72788.UNK.UNK.UNK.pb.heavy.1.raw 72788
cgtatcgcctccctcgcgccatcagacagtataatacacgaccggtgctcgatttagtatcactccagtcgcggggagctctggagaggagccaagccactagaagtcggccggtgttttccattcggtgatcagcactgaacacagaggactcaccatggagtttggctgagctgggttttcctcgttgctctttaagaggtgtccagtgtcaggtgcagctggtggagtctgggggaggcgtttgtccaagcctgggaggtccctgagacttctcctgtgcagcgtctggatttcaccttcagtacctatggcatgcactggtccgccaggctccaggcaaggggctggagtgggtggcacttatatggtatgatggaagtaataaatactatgcagactccgtgaagggccgattcaccatctccagagacaattccaagaacacgctgtatctgcaaataagaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccccctcctccaaagagcacctctggggcacagcggccctgggctgcctggtcaaggactactttccttatatactgtctgagcgggctggcaaggcgcatag

SEQ ID NO: 793836 - DNA, 703 bp, Homo sapiens
  misc_feature: 72822.44.45.E01.1.pb.heavy.1.raw 72822
cgtatcgcctccctcgcggccatcagacagtatatacacgaccggtgctcgatttagtgagtcagtaagggaaaggggctgggagaggagcccagcactagaagtcggccggtgtttccattcggtgatcagccactgaacacagaggactcaccatggagttttgggctgagctgggttttgcctcgttgctcttttaagaggtgtccagtgtcaggttcagctggtggagtctggggggaggcgtggtccagcctggacgtccctgagactctcctgtgttgcgtccggagctcagttttcagtgactctgccatggcactgggtccgcccaggctccaggcaaggggggctggagtgggtggcagtcatctggtctgatggaagtaaagaatactatggaaactccgtgaagggccgattctccgtctccagagacaattccaagaacaccgtgtatctacaatgaacaatcttgagagccgaggactccggctctcctattattgtacgagcccatcgttctactggggccagggagccctggtcaccgtctcctcagcccccaccaagggcccatcggtcttccccctggcgccctgctccaggagccacctccgagagcacagcggccctgggcctggcctggtcaaggactacttcctctatatactgtctgagcggcggctggcaaggcgcatag

SEQ ID NO: 793837 - DNA, 614 bp, Homo sapiens
  misc_feature: 72829.UNK.UNK.UNK.pb.heavy.1.raw 72829
catgcgccttgcagccgctcagacagtactcccttcgacggccatcagggcagtatgatacacgaccggtgctcgatttagtgtgagagttggtttggggggaagaggaagactgacggtcccactcccaggtacagcggtgcagtctggggctgaggtgaagaagcctggggcctcagtgacagtctcctgcacgggcttctggatacacgtcatcaattatgatattaactgggtgcgacaggccgctggacaagggctggagtggagggatggatgaagccctatagtggcaacacgggctttgccagaagttccaaggcagagttagtatgaccaggagcacctccccaggacagtctacatggaactgaagcagcctggagatctgaggacacggccggtatttctgtgcgagagccaaaccagcacctggcttgacttgtggggccagggaaccctggtcaccgtctcctccaggcctccaccaagggcccatcggtcttccccctggcgccctgctccaggagcacgctccgagagcacagcggcctgggctgcctggtcaaggactacttctataactgtctgagcgggctggcgaaggcgcatag

SEQ ID NO: 793838 - DNA, 598 bp, Homo sapiens
  misc_feature: 72835.44.78.H01.1.pb.heavy.1.raw 72835
ctatgcgccttgccagcccgctcagacagtatataggaagtagtccttgaccaggcagcccagggccgctgtgctctcggaggtgctccctggagcagggcgccagggggaagaaccgatgggccccttggtggaggctgaggagacggtgaccagggttccctggccccacaagtcaagccaggtgctggtggctctcgcacagaaatacacggccgtgtcctcagatctcaggctgctcagtttccatgtagactgtacctggggaggtgctcctggtcatactaactctgccttggaacttctgggcaaagcccgtgttgccactatagggcttcatccatcccatccactccagcccttgtccagcggcctgtcgcaacccagttaatatcataattgatgaacgtgtatccagaagccgtgcaggagactgtcactgaggccccaggcttctttcacctcagccccagactgcaccagctgtacctgggagtgggaccgtcagtcttcctcttccccccaaacccaaactactcacactaaatcgagcaccggtcgtgtatatactgtctgatggcgcgagggaggcgatacg

SEQ ID NO: 793839 - DNA, 717 bp, Homo sapiens
  misc_feature: 72846.44.39.D06.1.pb.heavy.1.raw 72846
cgtatcgcctccctcgcgccaatcagacagtatatacacgaccggtgctcgatttagtgacatctcgcagttctttgggggagagacgagcccagcactggaagttcgccggtgtttccattcggtgatcatcactgaacacagaggaactcaccatggagtttgggctgagctgggttttcctcgttgctcttttaagaggtgtccagtgtcaggagcacttggtggagtctgggggaggcgtggtccagcccgggaggtccctgagactctcctgtgtagcctctgggtttctcatttcgatagatttggttttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgacagcgtgagagttgacgacacgtctgttttattactgtgcgaggggggacctccaaggaaaacggtttcggggaatcataaactactactatttgatggatgtctggggcagggggaacgtcggtcaccgtctcctcagcttccaccaagggcccatcggtcttcccccctggcgccctgctccaggaagcaccttctggggcacagcggccctgggctgcctggtcaaggactacttcctatatactgtct

SEQ ID NO: 793840 - DNA, 723 bp, Homo sapiens
  misc_feature: 72852.44.85.H08.1.pb.heavy.1.raw 72852
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtccctttggccccagacgtccataccgtagtgtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccccttgcctggagcctggcggacccagtgcatgccataggtactgaaggtgaatccagacgctgcacaggagagtctcagggacctcccaggctggaccacgcctccccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctcccgcgactgagtgatactaaatcgagcaccggtcgtgatagtatagactgatggcgcgagggaggcgatacg

SEQ ID NO: 793841 - DNA, 698 bp, Homo sapiens
  misc_feature: 72857.44.55.E11.1.pb.heavy.1.raw 72857
cgtatcgcctcctcgcgccatcagacagtatatacacgaccggtgctcgatttagcactcgcacgttgggctttggggagaggagcccagcactgggattcgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaatgaacaacctgagaggcgacgacacggccgtctattactgtgcgagacaagtcggcgctcggagtggttattattcgtttgacttctggggcagggaaccctggtcaccgtcgcctccgcctccaccaagggcccatcgtcttcccccctggcaccctcctcaagagcacctctggggcacagcggccctgggctgcctggtcaaggactacttcctatatactgtctgagcgggctggcaaggcgcatag

SEQ ID NO: 793842 - DNA, 667 bp, Homo sapiens
  misc_feature: 72862.UNK.UNK.UNK.pb.heavy.1.raw 72862
cgtatcgcctccctcgcgccatcagacagtatatacacgacccggtgctcgatttagtagtgtagattccgcggggctttctgagagtccatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactgggctggatccgccagcccccagggaagggctggagtggattgggagtatctattatagtgggagcacctactacaacccgtccctcagagtcgagtcaccatatcagtagacacgtccaagaaaccagttctccctgaagctgagctctgtgaccgccgcggacacggccgtgtattactgtgcgagagtagggcagttcgtcaccaactactttgaccactggggccagggaaccctggtcaccgtctcctcagctccaccaaggcccatcgtccttccccctggcaccctcctccaagagcacctctggggggcacagcggccctgggctgcctgggtcaaggactaccttcctatatactgtctgagcggggctggcaagggcgcatag

SEQ ID NO: 793843 - DNA, 679 bp, Homo sapiens
  misc_feature: 72864.44.45.E01.1.pb.heavy.1.raw 72864
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccaccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcacgaggaaaacccagctcagcccaaactccatggtgagtcctctgtgttcagtgctgatcaccgaatggaaacaccgccgacttctagtgctgggctcctctcccagcccctttcccttactgactcactaatcgagcaccggtcgtgtatatactgtctgatggcgcgagggaggcgatacg

SEQ ID NO: 793844 - DNA, 677 bp, Homo sapiens
  misc_feature: 72870.44.53.E09.1.pb.heavy.1.raw 72870
ctatgcgccttgccagccgctcagacagtatataggaagtagtccttgaccaggcagcccaggccgctgtgctctcggaggtgctcctggagcagggcgccagggggaagaccgatgggccttggtggagctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtccaccgtccagctttggttctaatacggccaacccactccagccccttccctggagcctggcggacccaggtcatccaggcgttactgaaagtgatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctgggaatcccaaggctgggctcctctcccagagctcaacacactctctctaaatcgagcaccggtcgtgtatatactgtctgatggcgcgagggaggcgatacg

SEQ ID NO: 793845 - DNA, 614 bp, Homo sapiens
  misc_feature: 72873.44.23.C01.1.pb.heavy.1.raw 72873
cgtatcgcctccctcgcgcctcagacagtatatacacgaccggtgctcgatttagtacacgtgattagggattggggcagggtgaacacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcctcaagagtcgtctcaccatttcgaggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 793846 - DNA, 701 bp, Homo sapiens
  misc_feature: 72885.44.36.D03.1.pb.heavy.1.raw 72885
cgtatcgcctccctcgcgccatcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctgattcaccatcagtgaccactatatggactgggtcgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793847 - DNA, 685 bp, Homo sapiens
  misc_feature: 72897.UNK.UNK.UNK.pb.heavy.1.raw 72897
ctatgcgccttgccagcccgctcagacagtatataggaagtagtccttgaccaggcagcccagggccgctgtgcccccaagaggtgctcttggaggaggtgccagggggaagacgatgggccttggtggaggcggaggcgacggtgaccagggttccctggcccagaagtcaaacgaataataaccactcgagcgcgacttgtctcgcacagtaatagacggccgtgtcgtcgcctctcaggttgttcatttgaagataaaccgtgttcctggaattgtcccctggagatggtgaatcggccttcacggagttgcgtaggtatgtgaaatcaccagtataaatgctgagacccacctcagccccttccctggagcctggcggaccaaccatgtagttgctgctgacggtgagcccagagctgcacaggagagtctctggacccccccaggctggactaagcctcctccagactccatcagccgcacccacctgacaccttttaaagtccaacaaggagacccagctcagccaaaactccatggtgagtcctctgtgttcagtgctgatcaccgaatggaaacactcggaatccagtgctgggctcctctcccaaacccaacgtgcgagtgctaaatcgagcacggtcgtgtatatactgtctgatggcgcgagggaggcgatacg

SEQ ID NO: 793848 - DNA, 615 bp, Homo sapiens
  misc_feature: 72923.44.38.D05.1.pb.heavy.1.raw 72923
cgtatcgcctccctcgcgccatcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcggagttcggggagttgcatactactactacggtatggacgtctggggccaagggaccacggtcaccgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 793849 - DNA, 689 bp, Homo sapiens
  misc_feature: 72946.UNK.UNK.UNK.pb.heavy.1.raw 72946
ctatgcgccttgccagcccgctcagacagtatataggaagtagtccttgaccaggcagcccagggcgctgtgctctcggaggtgctcctggagcagggcgccaggggaagaccgatgggcccttggtggaggctgaggagacggtgaccagggttccctggccccagtggacagttcctgatataaacacaacaaaaatacatgcccgtgtcctcggttttcaggttagtcattcgcagaatcaatgagttcttgaagtcatctcgttgagagggtgaatctgctttcacagacgcggcgtactctgtgataaagctggcaactttgtttttactgcggccaagccactccaggccccttcctggagcctggcggacgccagtccatatagtggtcactgatggtgaatccagaggcgacacaggagagtctcagggaccctccaggctggaccaagtctcccccggactccaccaactgcacttcactctggacaccttgtaaataacaacaaggaaacccagctcagccgaactccatggtgagtcctctgtgttcagtgctgatcaccaaatgaaaacaccctggaattctgggctgggggctccccccccaagagagatcgtgacgcagctaaatcgagcaccgtcgtgtatatactgtctgatggcgcggagggaggcgatacg

SEQ ID NO: 793850 - DNA, 674 bp, Homo sapiens
  misc_feature: 72953.44.73.G07.1.pb.heavy.1.raw 72953
cgtatcgcctccctcgcgccatcagacagtatatacacgaccggtgctcgattagctctacgctcaggggggagacgagcccagcactggaagtcgccggtgtttccattcggtgatcatcactgaacacagaggactcaccatggactttgggctgagatggttttcctcgttgctctttagaggtggccagtgtcaggtgcagctagtggagtctggggaggagcggcccagcctggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagcccctcgagacggtcccgcttgactactggggccagggaaccctggtcaccgtctcctcagcctccaccagggcccatcgtcttcccctggcgccctgctccaggagcacctccgagagcacagcggccctgggctgcctggtcaaggactacttcctatatactgtctgagcgggctggcaagg

SEQ ID NO: 793851 - DNA, 705 bp, Homo sapiens
  misc_feature: 72966.44.55.E11.1.pb.heavy.1.raw 72966
ctatgcgcctgccaggcccgctcagacagtatataggaagtagtccttgaccaggcagcccagggcgctgtgcccccagaggtgctcttggaggaggcgtgccaggggaagaccgatgggccctgtggtggcggaaggcgacggtgaccagggttccctggccccagaaagtcaaacgaataataaccactcgagcgccgacttgttctcgcacagtaatagacggccgtgtcgtcgcctctcaggttgttcatttgaagataaaccgtgttcctggaattgtccctggagatggtgaatcggcccttcacggagttctgcgtagtatgtgaaatcaccagtataaatgactgagacccactccagccccttccctggagcctggcgcggacccaactcatgtagttgctgctgacggtgagcccagaggctgcacaggagagtctctggaccccccaggctggactaagcctcctccagaactccatcagccgcacctcacactggacaccttttaaaagtccaacaaggagaaccagctcagccaaaactccatggtgagtcctctgtgttcagtgctgatcaccgaatggaaaacacctcggaatcccagtgctgggctcctctcccaaacccaacgtgcgagtgctaatcgagcaccggtcgtgtatatactggtctgatggcgccgagggaggcgatacg

SEQ ID NO: 793852 - DNA, 700 bp, Homo sapiens
  misc_feature: 73000.44.36.D03.1.pb.heavy.1.raw 73000
ctatgcgccttgccagcccgctcagacagtatgataggaagtagtccttgaccaggcagccccggggccgctgtgctcgcgaggtgctcctggagcagggcgccagggggtaagaccgatgggcccttgggtggaggctgaggagacggtgaccagggttccctggccccagtgacagttcctgatataaacacaacacaataaatacatgccgtgtcctcggttttcaggttagtcattcgcagaatcaatgagttcttgaagtcatctcttggagggtgaatctgggctttcacagagcgcggcgtactctgtgataaagctggcaactttgtttttactgcggccaagccactccagccccttcctggagcctggcggacccagtccatatagtggtcactgatggtgaatccagaggcgacacaggaggtctcagggaccctccaggctggaccaagtctccccggactcacaactgcacttcactctggacaccttgtaaaataacaacaaggaaaaacccagctcagcccgaactccatggtgagtcctctgtgttcagtgctgatcaccaaatgaaaaacacctggaattctggggctggggctccgctctccccgaagagagatcgtgacgcagctaaatcgagcaccggtcgtgtatatacgtcttctgatggcgggagggaggcgatacg

SEQ ID NO: 793853 - DNA, 612 bp, Homo sapiens
  misc_feature: 73006.44.23.C01.1.pb.heavy.1.raw 73006
ctatgcgccttgccagcccgctcagacagtatataggaagtagtccttgaccaggcagcccagggcgctgtgcccccagaggtgctcctggagcagggcgccagggggaagaccgatgggccttggtggaagctgaggagacagtgaccagggtgccacggccccatagattgaaagaccagtctcgcctcgcacagaaataaacggcgtgtccgcggcggtcacggaggtcagtttcagggagaagcggttcatggacgtgtccctcgaaatggtgagacgactcttgagggacggagagtagtacgtcgccccagtataatgatgtcaccaatccactccattcccctccctggggctgccggatccagcccaagaatgatcagaactgatggaaactccagagacagtgcagatgagagacagggttccgaaggcctcaccagtcctggcccgactcctgcagctgcacctgggacaggacccatctgggagctgccaccagcaggaggaaaaaccacaggtgttcaccctgccccaatccctaatcacgtgtactaatcgagcaccggtcgtgtatatactgtctgatggcgcgagggaggcgatacg

SEQ ID NO: 793854 - DNA, 707 bp, Homo sapiens
  misc_feature: 73015.44.55.E11.1.pb.heavy.1.raw 73015
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccggggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793855 - DNA, 652 bp, Homo sapiens
  misc_feature: 73048.44.57.F02.1.pb.heavy.1.raw 73048
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 793856 - DNA, 702 bp, Homo sapiens
  misc_feature: 73057.UNK.UNK.UNK.pb.heavy.1.raw 73057
ctatgcgccttgccagcccgctcagacagtatataaggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaatcaccagtataatgactgagaccactccagccccttccctggagcctggcggacccaactcatgtagttgctgctgacggtgagcccagaggctgcacaggagagtctctggacccccccaggctggactaagcctcctccagactccatcagccgcacctcacactgacaccttttaaaaagtccaacaaggagaacccagctcagccaaaactccatggtgagtcctctgtgttcagtgctgatcaccgaatggaaacaccctcggaatcccagtgctgggctcctctccccaaacccaacgtgcgagtgctaaatcgagcacggtcgtgtatatactgtcttgatggcgcgagggaggcgatacg

SEQ ID NO: 793857 - DNA, 639 bp, Homo sapiens
  misc_feature: 73077.44.86.H09.1.pb.heavy.1.raw 73077
cgtatcgcctccctcgcgccatcagacagtatatacacgaccggtgctcgatttagtgctatagacttgggtttgggatgctttctgagagtcaaggacctcctgtgcaagaacatgaagcacctgtggtttttcctcctgctggtgcagctcccagatgggtcctgtccaggtgcagctgcaggagtcgggccaggactggtgaggccttcgggaaccctgtctctcatctgcactgtctctggagtttccatcagttctgatcattcttggggctgatccgcagccccagggagggaatggagtggattggtgacatccattatactggggcgacgtactactctccgtccctcaagagtcgtctcaccatttcgagggacacgtcatgaaccgcttctccctgaaactgacctccgtgaccgccgcggacacggccgtttatttctgtgcgaggcgagactggtctttcaatctatgggccgtggcaccctggtcactgtctcctcagcttccaccaaggcccatcgtcttcccctggcgccctgctcaggagcacctctgggggcacagcggcctgggctgcctggtcaaggactacttcctatatactgtctgagcggctggcaaggcgcatag

SEQ ID NO: 793858 - DNA, 600 bp, Homo sapiens
  misc_feature: 73085.UNK.UNK.UNK.pb.heavy.1.raw 73085
cccgacacgcttgctagggacttgagctaaggacgacatattgcctttagacagtcgaaggtgacgccttagctaccactgaacgttaggcgccagatgcggtctgggatgacctaactcgcagcttatcgatgatctactgcacgctcaaccaaccaggtcttgatgcgcgcgataggactgacgggacgctacagacatttaactcgctagtaacttaattgagatcctaggggatggataggaaatagaatccacccctatcaccccccacatagcctgcttggggtgttgagtttacttttatttcgtgttggaatgagttgaacttccggaagtggagtaatgggtttgtctacttcccctaaccgcaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcggttccgcagcttttgacctggaccagggtgcatagcctgcccagccttc

SEQ ID NO: 793859 - DNA, 609 bp, Homo sapiens
  misc_feature: 73102.44.36.D03.1.pb.heavy.1.raw 73102
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgtttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgtctgatggcgcgagggaggcgatacg

SEQ ID NO: 793860 - DNA, 706 bp, Homo sapiens
  misc_feature: 73105.44.36.D03.1.pb.heavy.1.raw 73105
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggttccgccaggctccagggaagggctggagtggcttggccgcagtaaaaacaaagttgccagctttatcacagagtacggccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793861 - DNA, 728 bp, Homo sapiens
  misc_feature: 73127.44.33.C11.1.pb.heavy.1.raw 73127
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtctctgtgttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 793862 - DNA, 665 bp, Homo sapiens
  misc_feature: 73130.44.12.B01.1.pb.heavy.1.raw 73130
ctatgcgccttgccagcccgctcagacagtatataggaagtagtccttgaccaggcagcccagggccgctgtgcccccagaggtgctcttggaggagggtgccaggggaagaccgatgggccttggtggaggctgaggagacggtgaccagggttccctgggccccagtggtcaaagtagttggtgacgaactgccctactctcgcacagtaatacacggccgtgtccgcggcggtcacaagagctcagcttcagggagaactggttcttggacgtgtctactgatatggtgactcgactcttgagggacgggttgtagtaggtgctcccactataatagatactcccaatccactccagcccccttccctggggctggcggatccagcccagtagtaactactactgctgatggagccaccagaagacagtgcaggtgagggacagggtctccgaaggcttcaccagtcctgggcccgactcctgcagctgcagctggacaggacccatctgggagccgccaccagcaggaggaagaaccacaggtgcttcatgttcttgcacaggaggtccatggactctcagaaagcccccgcggaatctacactactaaatcgagcaccggtcgtgtatatactgtctgatggcgcgagggaggcgatacg

SEQ ID NO: 793863 - DNA, 590 bp, Homo sapiens
  misc_feature: 73132.44.78.H01.1.pb.heavy.1.raw 73132
cgtatcgcctccctcgcgccatcagacagtatatacacgaccggtgctcgatttagtgtgagtagtttgggtttgggtggaagaggaagactgacggtcccactcccaggtacagctggtgcagtctgggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctcgagagcacagcggccctgggctgcctggtcaaggactacttcctatatactgtctgagcgggctggcaaggcgcatag

SEQ ID NO: 793864 - DNA, 709 bp, Homo sapiens
  misc_feature: 73134.44.73.G07.1.pb.heavy.1.raw 73134
cgtatcgcctcccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactcccgtgaagggccgatttcaccatctccagagacaattcccggaacactctgtacctggaaatgatcagcctgagaggcgaggactcggctctgtattactgtgcgagatcgggaaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793865 - DNA, 704 bp, Homo sapiens; identical to SEQ ID NO: 792843
  misc_feature: 73139.44.36.D03.1.pb.heavy.1.raw 73139

SEQ ID NO: 793866 - DNA, 696 bp, Homo sapiens
  misc_feature: 73143.44.27.C05.1.pb.heavy.1.raw 73143
cgtatcgcctccctcgcgccatcagacagtatatacacgaccggtgctcgatttagacgcgatcgaagggtttggggctgggagacgagcccagcactggaagtcgccggtgtttccactcgtgatcatcactgaacacagaggactcaccatggagtttgggctgagctgggttttctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtcgccaggctccaggcgaggggctggagtgggtggcaggtgtgtcatttcatggaggaatcaagtctacggtgattccgttgagggccgattcaccatctccagagacaattccgagaacacagtgtctcttcaatgaacagcctgagacctcaggacacggccgtgtatttttgtgcgagactatctgtttccaaaatcggttcattcgacgcctgggccagggaaccctggtcaccgtctcctcggcctccaccaagggcccatcggtcttcccctggcgccctgctccaggagcacctcgagagcacagcggccctgggctgcctggtcaaggactacttcctatatactgtctgagcgggctggcaaaggcgcatag

SEQ ID NO: 793867 - DNA, 712 bp, Homo sapiens
  misc_feature: 73151.UNK.UNK.UNK.pb.heavy.1.raw 73151
ctatgcgccttgccagcccgctcagacagctatataggaagtagtcctttgaccaggcagccagggccgctgtgcctcggaggtgctcctggagcagggcgccagggggaagacgatgggcccttggtggaggccgaggagacggtgaccaggggttccctggccccaggcgtcgaatgaaccgattttggaaacagatagtctcgcacaaaaatacacggccgtgtcctgaggtctcaggcttgttcatttgaagagacacctgtttctcggaattgctctggagatggtgaatcggccctcacggaatcaccgtagacttgattcctccatgaaatgacacacctgccacccactccagccccctcgcctggagcctggcggacccactgcattattccaattatcgaaggtgaatccagagggctgcacaggaagagtctcagggacccccctactggggccacgcctcccccagactcccacgaattgcacctgacacatgacacctcttaaagagggcaacgaggaaaacccagctcagccccaaactccatggtgagtcctctgtgttcagtgatgatcaccgagtggaaacaccggcgacttccagtgctgggctcgtctcccaggcccaaaacccttcgatcgcggtctaaatcgagcaccggtcgtgtatatactgttctgatggcgcggaggaggcgatacg

SEQ ID NO: 793868 - DNA, 610 bp, Homo sapiens
  misc_feature: 73154.UNK.UNK.UNK.pb.heavy.1.raw 73154
cccgacacgcttgctagggacttggagctaaggacgacatattgcctttagacagtcgaaggtgacgccttagctaccactgaacgtttaggcggccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgtttggaatgagttgaactttcgggaagtggagtaatgggtttgtctacttcccctaaccgcaaagtactagtttttacggagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggtccgcagcttttgacctggaccagggtgcatagcctgcccagccttc

SEQ ID NO: 793869 - DNA, 703 bp, Homo sapiens
  misc_feature: 73162.44.85.H08.1.pb.heavy.1.raw 73162
cgtatcgcctcctcgcgccatcagacagtatatacacgaccggtgctcgatttagtatcactcagtcgcgggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtctggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcacatctccagagacattcaagaacacgctgtatctgcaaatgaacagcctgagagccgagacacggctgtgtattactgtgcgaggacatattgtagtactacacctgctggactactactacggtatggacgtctgggggccaagggaccacggtcaccgtctcctcagcctccacaagggcccatcggtcttcccctggcaccctcctccaagagcacctctgggggcacagcggcctggctgcctggtcaaggactacttcctatatactgtctgagcgggctggcaaggcgcatag

SEQ ID NO: 793870 - DNA, 673 bp, Homo sapiens
  misc_feature: 73164.UNK.UNK.UNK.pb.heavy.1.raw 73164
cgtatcgcctccctcgcgccatcagacagtacgaccggtgctcgatttagagagagtgtgttgagctctgggagaggagccccagccttgggattccaggtgttttcattcagtgatcaggactgaacacagaggactcaccatggagtttgggctgagctggattttccttgctgctattttaaaaggtgtccagtgtgaggtgcagttggtggagtctggggaaggtttggtaaagcctggggagtcccttagactctcctgtgcagcctctggattcactttcagtaacgcctggatgacctgggtccgccaggctccagggaaggggctggagtgggttggccgtattagaaccaaagctgacggtggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcgtcttcccctggcgccctgctccaggagcacctccgagagcacagcggccctgggctgcctggtcaaggactacttcctatatactgtctgagcgggctggcaaggcgcatag

SEQ ID NO: 793871 - DNA, 747 bp, Homo sapiens
  misc_feature: 73169.44.86.H09.1.pb.heavy.1.raw 73169
cgtatcgcctccctcgcgccatcagacagtatatacacgaccggtgctcgatttagtgctatagacttggtttggggagctctgggagaggagccccagcccaccagaagtcggcggtgtttccagtccggtgatcagcaccgaacaccagaggactcaccatggagtttgggctgacctgggttttcctcgttgctcttttaagaggtgtccagtgtcaggtgaagctggtggagtcctgggggaggccgtggtccagcctgggaggttcccctgagactctcctgtgtagcgtctggattcacctttcaacagacatggcatgcactgggtccgccaggctccaggcaagggaactggagtgggtggcacttatatggtatgatggaagtaataaatattatgttagattccgtgaagggccgattcaccatctccagaggacaattcgaagaacacactatatctggaaaatgaatagcctgagagccgaggacacggctgtctactactgtgcgagagaatggggcctcgtgggatacagatatgacattgctctactccaatggtatggacgcctggggcaagggaccacggtcgccgtctcctcagcctcaccagagggcccatcggtcttccccctggcaccctcctccaagagcacctctgggggcacagcggcctgggctgcctggtcaaggactacttcctatatacgggtctgagcgggctggcaaggcgccatag

SEQ ID NO: 793872 - DNA, 680 bp, Homo sapiens
  misc_feature: 73187.44.36.D03.1.pb.heavy.1.raw 73187
cagcccgctcaacagtatataggaagtagtccttgaccaggcagcccaggccgctgtgcttcggaggtggctcctggagcagggcgccaggggaagaccgatgggcccttgtggaggctgaggagacggtgaccagggttccctgccccagtggacagttcctgatataaacacaacacaataatacatgccgtgtcctcggttttcaggttagtcattcgcagaatcaatgagttcttgaagtcatctcttgagagggtgaatctggctttcacagacgcggcggtactctgtgataaaagctggcaactttgtttttactgcggccaagccactccagcccttccctggagcctggcggacccagtccatatagtggtcactgatggtgaatccagaggcgacacaggagagtctcaggaccctccaggctggacaagtctcccccggactccaccaactgcacttcactctggacacctttaaaataacaacaaggaaaacccagctcagcccgaactccatgtgagtctctgtgttcagtgctgatcaccaaatgaaaacacctgggaattctggggctggggctccgcttcagagctccccaagagagatcgtgacgcagctaatcgagcaccggtcgtgtatatactgtctgatggcgcgagggaggcgatacg

SEQ ID NO: 793873 - DNA, 662 bp, Homo sapiens
  misc_feature: 73208.44.23.C01.1.pb.heavy.1.raw 73208
ctatgcgccttgccaagcccgctcagaacagtatataggaagtagtccttgaccagggcagcccagggcccgcctgtgccccagaggtgctcctggagcagggcggccagggggaagaccgatgggcccttggtggaagctgaggagacagtgaccagggtgccacggcccgccatagattgaaagacagtctcgcctcgcacagaaataaaaacggccgtggtccgcggcggtcacggaggtccagtttcagggagaagcggttcatggacgtgtccctcgaaatggtgagacgactcttgagggacggagagtagtacgtcgccccagtataatgatgtcaccaatccactccattcccctccctggggctgccggatccagccccaagaatgatcagaactgatggaaactccagagacagtgcagatgagagacaggggttcccgaaggcctcaccagtctggcccgactcctgcagctgcacctgggacaggacccatctgggagctgccaccagcaggaggaaaaaaccacaggtgctcatgttcttgcacaggaggtccttgactctcagaaaagcccccaatccctaaatcacgtgtactaaatcgagcaccggtcgtgtatatactgtctgatggcgcgagggaggcgatacg

SEQ ID NO: 793874 - DNA, 667 bp, Homo sapiens
  misc_feature: 73224.UNK.UNK.UNK.pb.heavy.1.raw 73224
cgtatcgcctccctcgcgccatcagacagtatatacacgacccggtgctcgattagagctctatcagggggagcatcactaacaacccattcctcctctaaagaagcccctggagcacagctcatcaccatggactggacctggaggttcctctttgtggtggcagcagcaacaggtgtccagtccctggtgcaactggtgcagtctggactagaatgccgcaaccttggtcctcggtgacccttttcctgcacggcctctggaagtactaccagttccactactataccatcaactggtgcgccaggcccctggacaagggcttgagtggatgggtggaatcatccctctttttggctcactcacctacgcacgagacttccggggcagaattacgattaccgcggacaagtccacagcacagtctccatgacaatgagttctttgaaatccgacgacacgcccgtctactactgtgcgagaggtccgtaccccagctcgcatggagcctttgagatctgggggcagggaaccctggtcattgtcacctcagcttccaccaagggcccatcggtcttcccccctggcgccctgctccaggagcactctgggcacgcggccctgggctgcctggtcaaggactactccctatatactgtctgagcgg

SEQ ID NO: 793875 - DNA, 627 bp, Homo sapiens
  misc_feature: 73236.44.86.H09.1.pb.heavy.1.raw 73236
ctatgcgccttgcagcccgctcagcagtatataggaagtagtccttgaccaggcagcccaggccgctgtgccccagaggtgctcctggagcagggcgccagggggagaccgatgggcccttgtggaagctgaggagacagtgaccagggtgccacggccccatagattgaaagacagtctcgcctcgcacagaaataaacggccgtgtccgcgcgtcacggaggtcagtttcaggagaagcggttcatggacgtgtccctcgaaatggtgagacgactcttgagggacggagagtagtacgtcgcccagtataatggatgtcaccaatcactcattcccctccctgggggctgcggatccagcccagaatgatcagaactgatggaaactccagagacagtgcagatgagagacagggttccgaaggcctcaccagtcctgggcccgactcctgcagctgcactggacaggaccatctggagctgcaccagcaggaggaaaaacacaggtgcttcatgttcttgcacaggaggtccttgactctcagaaagcatcccaaccagtctatagcactaatcgagcaccggtcgtgtatatactgtctgatggcgcgagggaggcgatacg

SEQ ID NO: 793876 - DNA, 569 bp, Homo sapiens
  misc_feature: 73237.44.78.H01.1.pb.heavy.1.raw 73237
cgtatcgcctccctcgcgccatcagacagtatatacacgaccggtgctcgatttagtgtgagtagttgggttgggtgccgaagttgctggaggtcacggtcaccacgctgctgagtgaagaagcctggggcctcagtgacagtctcctgcacggcttctggatacacgttcatcaattatgatataactgggtgcgacaggccgctggacaaggctggagtggatggatggatgaaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggcaggaaccctggtcaccgtctcctcagccttccaccagggcccatcggtcttcccccctggcgccctgctccaggagcacctccgagagcacagcgcggccctggctgcctggtcaaggactacttcctatatactgtctgaggcgggctggcaaggcgcatag

SEQ ID NO: 793877 - DNA, 645 bp, Homo sapiens
  misc_feature: 73251.44.23.C01.1.pb.heavy.1.raw 73251
cgtatcgcctcctcgcgccatcagtctatactatcacgaccggtgctcgattagtacacgtgattagggattggggctttctgagagtcaaggacctcctgtgcaagaacatgaagcacctgtggtttttcctcctgctgtggcagctcccagatgggtcctgtcccaggtgcagctgcaggagtcgggccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 793878 - DNA, 691 bp, Homo sapiens
  misc_feature: 73262.UNK.UNK.UNK.pb.heavy.1.raw 73262
ctatgcgccttgccagcccgctcagacagtatataggaagtagtccttgaccaggcagcccaggggccgctgtgcccccataggtgctcctggagcagggcgccaggggaagaccgatgggcccttggtggaagctgaggagacggtgacagggttccctggccccaggggtcgaaccaatttccatgtgtgggactatgagagggactatgaaaagttgacgagggctctcgcacagaaatagatggccgtgtcttcagatctcagcctgctcagctccatgtaggctgtactcgtgattcgtccgcaggtaatggtgactctgtcctgaaacttctgtgcgtaattcgatgcaccaaagatagggatgatcctcccagccactcaagcccttgtccaggggcctgtccgcacccaataaaaagcatagctgaagaaggtgccctccagaagccttgcaggagaccttcaccgaggacccaggcttcttcacctcagcccagactgcaccagctgcacctgggactggacacctgtagctgctgccacacaaagaggaaccgccaggtccagtccatggtgatgagctgtgctcccaggggcttctttaaggaggagtgtggttgttatgtgatcaaatcgagcacccggtcgtgtatatactgtctgatggcgcgagggaggcgatacg

SEQ ID NO: 793879 - DNA, 707 bp, Homo sapiens
  misc_feature: 73289.44.70.G04.1.pb.heavy.1.raw 73289
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggtcccctggccccagtcatgcgcccggtaataactactaccactcccgatctcgcacagtaatacagagccgagtcctcgactctcaggctgaccattttccaagtacacaatgttccgggaattgtctctggagatggtgaatcggcccttcacggagtctgcataatattcagaacttccatcatgtgctataactgccaaccactccggcccttgcctggagcctggcggacccagtgcatgccagaaccactgaaactaaatccagaggcttcacaggagagtctcagggacctcccaggctggaccacgcctccccagactccaccaggtgcacctgacagtggacacctcttaaaagagcaacgaggaaaacccagctcagcccaaactccatggtgagtcctctgtgttcagtgctgatcaccgaatggaaacaccggccgacttctagtgctgggctcctctcccagacccctttcccttcacactacactaaatcgagcaccggtcgtgtatatactgtctgatggcgcgagggaggcgatacg

SEQ ID NO: 793880 - DNA, 704 bp, Homo sapiens
  misc_feature: 73296.44.73.G07.1.pb.heavy.1.raw 73296
cgtatcgcctccctcgcgccatcagacagtatatacacgaccggtgctcgatttagctctacgctcagggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793881 - DNA, 695 bp, Homo sapiens
  misc_feature: 73298.44.71.G05.1.pb.heavy.1.raw 73298
cgtatcgcctccctcgcgccatcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcgggggggggcttggcacagccagggcggtctctgagactctcctgtgtagtctcagggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggcctgggctgcctggtcaaggactattcctatatactgtctgagcgggctggcaaggcgcatag

SEQ ID NO: 793882 - DNA, 726 bp, Homo sapiens
  misc_feature: 73308.UNK.UNK.UNK.pb.heavy.1.raw 73308
cgtatcgcctccctcgcgccatcagacagtatatacacgaccggtgtgcgatttagacgcgattcgaaaagggtttggggctggagacgagcccatcactgggaagttcgccggtggtttccactcggttagtcatcactgaacacagaggactcaccaatggagtttgggctgagctgggttttcctcgttgccctcttttaagagggtgtcatgtgtcaggtgcaattcgtggagtctgggggggaggcgtggcccagtagggggtccctgagactctcctgtgcaagcctctggattcaccttcgataattggaatatgcagtgggtccgccaggctccaggcgagtgggctggagtgggtggcaggtgttgtcaaatttcatggagaaaatcaaagtctacggtgattccgtttgagggccgattcaccatctccagagacaattccgagaacacagtgtctcttcaaatgaacagcctgagacctcaaggacacgccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttccctataaactgtctgagcgggctggcaaggcgcatcttcgt

SEQ ID NO: 793883 - DNA, 706 bp, Homo sapiens
  misc_feature: 73320.44.55.E11.1.pb.heavy.1.raw 73320
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttcctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagggctgcacaggagagtctctgggaccccccaggctggactaagcctcctccagactccatcagccgcacctcacactggacaccttttaaaagtccaacaaggagaaacccagctcagccaaaactctccatggtgagtcctctgtgttcagtgctgatcaccgaatggaaacacctcgaatcccagtgctgggctcctctccccaaacccaacgtgcgagtgctaaatcgagcaccggtcgtgtatatactgtctgatggcgcgagggaggcgatacgatc

SEQ ID NO: 793884 - DNA, 705 bp, Homo sapiens
  misc_feature: 73342.44.70.G04.1.pb.heavy.1.raw 73342
cgtatcgcctccctcgcgcatcagacagtatatacacgaccggtgctcgatttagtgtagtgtgaagggaaagggtctgggagaggagcccagcactagaagtcggcggtgtttccattcggtgatcagcactgaacacagagactcaccatggagtttgggctgagctgggttttctcgttgctcttttaagagtgtccactgtcaggtgcacctggtggagtctgggggaggcgtggtccagcctgggaggtcctgagactctcctggtgaagcctctggatttagtttcagtggttctggccatgcactgggtccgccaggcttccaggcaagggccggagtggtttggcagtttatagcacatgatggaagttctgaatattatgcagactccgtgaaagggccgattcaccatctccagagacaattcccggaacattgtgtactggaaatggtcagcctgagagtcgaggactcggctctgtattactgtgcgagatcgggaggtggtagtagttattacgggcgcatgactggggccaggggaccctggtcaccgtctcctcagcctccaccaaggggccatcggtcttccccctggcgccctgctccaggagcacctccgagagcacagcggccctgggctgcctggtcaaggactacttcctatatactgtctgagcgggctggcaaggcgcatag

SEQ ID NO: 793885 - DNA, 708 bp, Homo sapiens
  misc_feature: 73343.44.27.C05.1.pb.heavy.1.raw 73343
ctatgcgccttgccagcccgctcagacagtatataggaagtagtccttgaccaggcagcccaggccgctgttgctctcgaggtgctcctggagcagggcgccaggggaagaccgatggcccttggtggaggccgaggagacggtgaccagggttccctgaggccccaggcgtcgaatgaaccgattttggaaaccagatagtctcgcacaaaaatacacggccgtgtcctgaggtctcaggctgttcatttgaagagacactggtgttctcggaattgtctctggagatggtgaatcggcctcaacggaatcaccgtagacttgatttcctccatgaaatgacacaccttgccaccactccagcccctcgcctggagcctggcggacccactgcatattccaattatcggaggtgaatccagaggctgcacagagagtctcaggacccccctactggggcaacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctggctcgtctcccagggctccccaaacccttcgatcgcgtctaaatcgagcaccggtcgtgtatatactgtctgatggcgcgaagggaggcgcgatacg

SEQ ID NO: 793886 - DNA, 573 bp, Homo sapiens
  misc_feature: 73348.44.78.H01.1.pb.heavy.1.raw 73348
cgtatcgcctccctccctcgcgccatcagacagtatatacacgaccggtgctcgatttagtgtgagtagtttgggtttggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgccagaagttccaaggcagagttagtatgaccaggagcacctccccaggtacagtctacatggaactgagcagcctgagatctgaggacacggccgtgtatttctgtgcgagagccaccagcacctggcttgacttgtggggccaggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793887 - DNA, 683 bp, Homo sapiens
  misc_feature: 73349.44.53.E09.1.pb.heavy.1.raw 73349
ctatgcgccttgccagcccgctcagacagtatataggaagtagtccttgaccaggcagcccagggccgctgtgctctcggaggtgctcctggagcaggggcgccaggggaagaccgatgggcccttggtggaggctgaggagacggtgaccagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactccccaggctttaccaaacctcccccagactccaccaactgcacctcacactggacaccttttaaaatagcagcaaggaaaatccagctcagcccaaactccatggtgagtcctctgtgttcagtcctgatcactgaatgaaaacacctgggaatcccaaggctggggctcctctcccagagctcaacacactctctctaaatcgagcaccggtcgtgtatatactgtctgatggcgcgagggaggcgatacg

SEQ ID NO: 793888 - DNA, 703 bp, Homo sapiens
  misc_feature: 73353.44.27.C05.1.pb.heavy.1.raw 73353
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccaccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaaccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggagggcgatacg

SEQ ID NO: 793889 - DNA, 703 bp, Homo sapiens
  misc_feature: 73357.UNK.UNK.UNK.pb.heavy.1.raw 73357
cggtatcgcctccctcgcgcccatcagacagtatatacacgacggtgctcgatttagctgcgctcacgatctctttggggagctctgagagcggagcccccagccccagaattcccaggtgtttttcatttggtgatcagcactgaacacagaggactcaccatggagttcgggctgagctgggttttccttggttgttattttacaaggtgtcgcagagagtgaagtgcagttggtggagtccgggagacttggtccagcctggagggtccctgagaactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaaggcccatcggtcttcccccctggcgcccctgctccaggagcacctccgagagcacagcgggccctgggctgcctggtcaaggactacttcctatatactgtctgagcgggctggca

SEQ ID NO: 793890 - DNA, 680 bp, Homo sapiens
  misc_feature: 73362.44.35.D02.1.pb.heavy.1.raw 73362
cgtatcgcctccctcgcgccatcagacagtatatacacgaccggtgctcgatttagcacacgatagttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaaggactggagtggattgggcgcatctataacagtggcagcaccaactacaacccccgccctcaagagtcggagtcaccatgtcactagacaggtccaagaaccagttctccctgaaattgacttctgtgaccgccgcggacacggccgtatattattgtgcgagagattcctagtcgatacagtagagacggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793891 - DNA, 644 bp, Homo sapiens
  misc_feature: 73375.44.19.B08.1.pb.heavy.1.raw 73375
ctatgcgccttgccagcccgctcagacagtatataggaagtagtccttgaccaggcagcccagggccgctgtgctctcggaggtgctcctggagcagggcgccagggggaagaccgatgggcccttggtggaggctgatgagacggtgacctggatttccctggccccagggttcgaagaagcccgtggtcattgtggtcatgaagtggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggccttttccgggggctgccgcacccagacaacgccctctccaggagtgacgagtgagaagcctgagacggtgcaggtcagcgtgagggtctgtgtgggtttcaccaatgtagggccagactcttttcacgtgatctgggacaggcccatgaagggatggtcagcagcaggagcgtggagcaaagtgtgtccatggtggggcacaggagtccccttactgactcactaaatcgagcaccggtcgtgtatatactgtctgatggcgcgagggaggcgatacg

SEQ ID NO: 793892 - DNA, 624 bp, Homo sapiens
  misc_feature: 73377.UNK.UNK.UNK.pb.heavy.1.raw 73377
cccgacacgctgctaggcgacttggagctaaggacgacatattgcctttagacagtcgaaaggtgacggccttagctaccactgacgtttaggcgccagattgcggtctgggatgacctaactcgcagcttatcgatgatcttactgcacgctcaaccaaacccaggtcttgatgcgcgcgataggactgacggggatcgctacagacatttaactcgctagtaacttaattgagatcctaggggatgggataggaaatagaatccacccctatcacccccccccacatagcctgcttggggtgttgagttttacttttatttcgtgttggaatgagttgaacttccgggaagtggagtaatgggtttgtctacttcccctaaccgcaaagtactagttttacgagtggcggttgcaagccatagcccagtcacaggtaataaacaattcaacgtggcgtaaagattggccgcttgctgtgggcattgcaagctgggtttgccagcattgtgcatgctagacgaccaatatgaatctgcgggacccctagtggccaagatggccgctagcggggttccgcagcttttgacctggaccaggggtggcatagcctgcccagccttc

SEQ ID NO: 793893 - DNA, 734 bp, Homo sapiens
  misc_feature: 73381.44.33.C11.1.pb.heavy.1.raw 73381
ctatgcgccttgccagccccgctcagaccagtatataggaagtagtccttgaccaggcagcccagggccgctgtgccccagaggtgctcttggaggagggtgccagggggaagaccgatgggccctttggtggaggctgaggagacggcgaccgtggtcccttggccccaggcgtccataccattggagtagagcatgtcatatctgtatccacgagccccatctctcgcacagtagtagacagcgtgttcctcggctctcaggctattcatttccagatatagtgtgttcttcgaattgtctctggagatggtgaatcgggcccttcacggaatctacataatatttattactttccatcataccatataagtgccacccactccagtcccttgcctggagcctggcggacccagtgcatgccatgtctgttgaaggtgaatccagacgctacacaggagagtctcagggactcccaggctggaccacgcctccccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctcccaaacccaacgagctcactctaaatcgagcaccggtcgtggtatatactgtctgatggcgcgagggaggcgatacg

SEQ ID NO: 793894 - DNA, 658 bp, Homo sapiens
  misc_feature: 73423.44.12.B01.1.pb.heavy.1.raw 73423
cgtatcgcctccctcgcgccatcagacgtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcactgcactgtctctggtggctccatcagcagtagtagttactactggggcctggatccgccagcccccagggaaggggctggagtggattgggagtatctattatagtgggagcacctactacaacccgtccctcagagtcgagtcaccatatcagtagacacgtccaagaaccagttctccctgagctgagctctgtgaccgccgcggacacggccgtgtattactgtgcgagagtagggcagttcgtcaccaactactttgaccactggggcagggaaccctggtcaccgtctcctcagcctccacaagggcccatcggtcttcccctggcacccctcctccaagagcacctctggggcacagcggccctggctgcctggtcaaggactacttcctatatactgtctgagcgggctggcaaggcgcatag

SEQ ID NO: 793895 - DNA, 723 bp, Homo sapiens
  misc_feature: 73433.44.85.H08.1.pb.heavy.1.raw 73433
ctatgcgccttgccagcccgctcagacagtatataggaagtagtccttgaccaggcagcccagggcccgctgtgcccccagaggtgctcttggaggagggtgccagggggaagaccgatgggcccttggtggaggctgagagacggtgacccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtcctctggagatggtgaatcggcccttcacggagtctgcatagtatttattacttccatcataccatataattgccacccactccagccccttgctggagcctggcggacccagtgcatgccataggtactgaaggtgaatccagacgctgcacaggagagtctcagggacctcccaggctggaccacgcctccccagactccaccagctgcacctgacactggacacctcttaaaaagagcaacgaggaaaacccagctcagcccaaactccatggtgagtcctctgtgttcagtgctgatcaccgaatggaaacaccgccgacttctagtgctgggctcctctccagagcccccgcgactgagtgatactaaatcgagcaccggtcgtggtatatactgtctgatggcgcgagggaggcgatacg

SEQ ID NO: 793896 - DNA, 669 bp, Homo sapiens
  misc_feature: 73435.44.45.E01.1.pb.heavy.1.raw 73435
cgtatcgcctcctcgcgccatcagacagtatatacacgaccggtgctcgattagtgagtcagtaagggaaggggctgggagaggagcccagcactagaagtcggcgtgtttccattcgtgatcagcactgaacacagaggactcaccatggagtttgggctgagctgggtttcctcgttgctctttaagaggtgtccagtgtcaggttcagctgtggagtctgggggaggcgtggtccagcctgggacgtccctgagactctcctgtgttgcgtccggactcagttcagtgactctgccatgcactgggtccgccaggctccaggcaagggctggagtgggtggcagtcatctggtctgatggaagtaagaatactatggaaactcgtgaagggccgattctccgtctccagagacaattccaagaacaccgtgtatctacaaatgaacaattgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793897 - DNA, 674 bp, Homo sapiens
  misc_feature: 73460.44.71.G05.1.pb.heavy.1.raw 73460
cgtatcgcctccctcgcgccatcagacagtatatacacgaccggtgctcgatttagtgtcgtcgcaagagagaggggcccagccctggggactgaacagagagaactcaccatggagtttgggctgagctggctttttcttgtggctgttttaaaaggtgtcagtgtgaagtgcagctgttggagtcggggggaggcttggtacagccggggggtccctgacactctcctgtgcagcctctggattcgcctttaatacctatgccatgatctgggtccgtcaggccccagggaaggggctggagtgggtctcatccattactggtggtaagtgccacaaatgtcgcagactccgcgtgaagggccgcttcatcgtctccagggacaattccaagaatacggtgtttctgcagatgaagagcctgcgagtggacgacacggcctttattactgtgccaagaggtcgcagaagttacaacaatacaagtattactactacatggacgtctggggcaaagggacccggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 793898 - DNA, 697 bp, Homo sapiens
  misc_feature: 73474.44.36.D03.1.pb.heavy.1.raw 73474
cgtatcgcctcctcgcgccatcagacagtatatacacgaccggtgctcgatttagctgcgtcacgatctctctttgggggagagcggagccccagccccagaattcccgggtgttttcatttggtgatcagcactgaacacagaggactcaccatggagttcgggctgagctgggttttccttgttgttattttacaaggtgtccagagtgaagtgcagttggtggagtccggggagacttggtccagcctggaggggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagcagattcaccctctcaagagatgacttcaagaactcattgattctgcgaatgactaacctgaaaaccgaggacacgggcatgtattattgtgttgtgtttatatcaggaactgtccactgggccaggaaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793899 - DNA, 597 bp, Homo sapiens
  misc_feature: 73509.UNK.UNK.UNK.pb.heavy.1.raw 73509
cccgacacgcttgctagggacttggagctaaggacgacatattgcctttagacagtcgaaggtgacgccttagctaccactgaacgttaggcgccagatgcggtctgggatgacctaactcgcagcttatcgatgatctactgcacgctcaaccaaccaggtctgatgcgcgcgataggactgacgggatcgctacagacatttaactcgctagtaacttaatgagatcctaggggatggataggaaatagaatccaccctatcacccccccacatagcctgcttggggtgttgagtttacttttattcgtgttggaatgagttgaacttccgggaagtggagtaatgggtttgtctacttccctaaccgcaagtactagttttacgagtggccgttgcaagccatagccagtcacaggtaataaacaattcaacgtggcgtaagattggccgcttgctgtgggcattgcaagctgggtttgcagcattgtgcatgctagacgacaatatgatctgcggacccctagtgccaagatggccgctagcgggttccgcagcttttgacctggaccagggtgcatagcctgcccagccttc

SEQ ID NO: 793900 - DNA, 711 bp, Homo sapiens
  misc_feature: 73510.UNK.UNK.UNK.pb.heavy.1.raw 73510
ctatgcgccttgccagcccgctcagacagtatataggaagtagtccttgaccagggcagcccagggccgctgtgctctcggaggtgctcctggagcaggggcgccagggggaagaccgatgggcccttggtggaggctgaggagacggtgaccagggttccctggccccaagtggacagttcctgatataaacacaacacaataatacatgcccgtgtcctcggttttcaggttagtcattcgcaagaatcaatgagttcttgaagtcatctcttgagagggtgaatctggctttcacagacgcggcgtaactctgtgataaagctggcaacttgtttttactgcggccaagccactccagccccttccctggagcctgggcggacccagtccatatagggtcactgatgggtgaatccagaggcgacacaggagagtctcagggaccctccaggctggaccaagtctccccggactccaccaactgcacttcactctggacaccttgtaaaataacaacaaggaaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtccgtgtatatactgtctgatggcgcgagggaggcgatacg

SEQ ID NO: 793901 - DNA, 703 bp, Homo sapiens
  misc_feature: 73543.44.55.E11.1.pb.heavy.1.raw 73543
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcgggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaaggggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcggctggcaaggcgcatag

SEQ ID NO: 793902 - DNA, 681 bp, Homo sapiens
  misc_feature: 73553.44.70.G04.1.pb.heavy.1.raw 73553
ctatgcgccttgccagcccgctcagacagtatataggaagtagtccttgaccaggcagcccaggcgctgtgctctcggaggtgctcctggagcagggcgccaggggaagaccgatggcccttggtggaggctgaggagacggtgaccaggtccctggccccagtcatgcgcccggtaataactactacacctcccgatctcgcacagtaatacagagccgagtcctcgactctcaggctgaccatttccaagtacacaatgttccggaattgtctctggagatgtgaatcggcctcacggagtctgcataatattcagaacttccatcatgtgctataactgccaccactcggcccttgctggagctggcggacccagtgcatgcagaaccactgaaactaatcgaggcttcacaggagagtctcagggacctcccaggctggacacgcctccccagactccaccagtgcacctgacagtggacacctcttaaagagcaacgaggaaaacccagctcagccaaactccatggtgagtcctctgtgttcagtgctgatcacgaatggaaacaccgcgacttctagtgctgggctcctctcccagacccctttcccttcacactacactaaatcgagcaccggtcgtgatagtatagactgatggcgcgagggaggcgatacg

SEQ ID NO: 793903 - DNA, 668 bp, Homo sapiens
  misc_feature: 73598.UNK.UNK.UNK.pb.heavy.1.raw 73598
ctatgcgccttgcagcccgctcaggaacagtatataggaagtagtccttgaccaggcagcccaggggccgctgtgccccccagaggtgctcctggagcagggcgcgccaggggggaagaccgatgggcccttggtggaagctgaggagacagtgaccagggtgccacggcccccatagattgaaagaccagtctcgctcgcacagaaataaacggccgtgtccgcgcggtcacggaggtcagtttcagggagaagcggttcatgggacgtgtccctcgaaatggtggaacgacctcttggagggacggagaaggtacgtcgcccccagtataatggatggtcaccaatccactccattcccccctctggggctgccggatccagcccccaaagatgatcaaactgatggaactccaggacagtgccagatgagagacagggttcccgaaaggcctcaccagtccctgggcccgactcctgcagctgcacctggacagggacccatctgggagctgccacccagcaggaggaaaaaccacaggtgcttcatgttcttgcacaggaggtccttgactctcagaaaagcatccccaaacccaagtctatagcactaaatcgagccaccggtcggtgtatatactggtctgatggcgcgaggaggcgatacg

SEQ ID NO: 793904 - DNA, 701 bp, Homo sapiens
  misc_feature: 73602.UNK.UNK.UNK.pb.heavy.1.raw 73602
ctatgcgccttgccagcccgctcagacagtatataggaagtagtccttgaccaggcagcccagggccgctgtgcccccagaggtgctcctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaaggcccttccctggagcctgacggacccaggccaagtgataatcactaagactgaatcctgagactacacaggagagtctcagagaccgccctggctgtgcaaagcccccccccgactccgccagtcgcccctcgcactggacaccttctaaaaaaactacaaggaaaatcaagattagcccaaactccatgggttggtggtctgtgctcagtgctgatcaccaagtgggcaaactcctgggaatctcacggctggggcctcctctctttgcgacgacactaaatcgagcaaccgggtcgtgtatatactgtctgatggcgccgagggaggcgatacg

SEQ ID NO: 793905 - DNA, 668 bp, Homo sapiens
  misc_feature: 73695.44.36.D03.1.pb.heavy.1.raw 73695
taggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggaccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctgggctggggctccgctctcagagctccccaagagagatcgtgacgcagctaatcgagcaccggtcgtgtatatactgtctgatggcgcgaggaggcgatacg

SEQ ID NO: 793906 - DNA, 699 bp, Homo sapiens
  misc_feature: 73696.44.55.E11.1.pb.heavy.1.raw 73696
ctatgcgccttgccagcccgctcagacagtatataggaagtagtccttgaccaggcagcccagggccgctgtgcccccagaggtgctcttggaggagggtgccagggggaagaccgatggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataatgactgagacccactccagccccttcctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctccccccaaacccaacgtgcgagtgctaaatcgagcaccggtcgtgtatatactgtctgatggcgcgagggaggcgatacg

SEQ ID NO: 793907 - DNA, 663 bp, Homo sapiens
  misc_feature: 73709.UNK.UNK.UNK.pb.heavy.1.raw 73709
ctatgcgccttgccagcccgctcagacagtatataggaagtagtccttgaccaggcagcccaggccgctgtgctctcggaggtgctcctggagcagggcgccaggggaagacgatgggccttggtggaggctgaggagacggtgacagggttccctggcccgaatgaaaccatcccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagcttggttctaatacggccaaccactccagcccttccctggagcctggcggacccaggtcatccaggcgttactgaaagtgaatccagaggctgcacaggaggtctaaggactcccaggctttaccaaacctccccagactccaccaactgcacctcacactgacacctttaaaatagcagcaaggaaaatccagctcagcccaaactccatggtgagtctctgtgttcagtcctgatcactgaatgaaaacacctgggaatcccaaggctgggctcctctcagagctcaacacactctctctaatcgagcacggtcgtgtatatactgtctgatggcgcgagggaggcgatacg

SEQ ID NO: 793908 - DNA, 707 bp, Homo sapiens
  misc_feature: 73716.44.55.E11.1.pb.heavy.1.raw 73716
cgtatcgcctccctcgcgccatcagaacagtatatacacgaccggtgctcgatttagcactcgcacgttgggtttggggagaggagcccagcactgggattccgaggtgtttccattcggtgatcagcactggaacacagaggactcaccatggagtttggctgagctgggttctccttgtggactttaaaaaggtgtccagtgtgaggtgcggctgatggagtctggaggaggcttagtccagcctgggggggtcccagagactctcctgtgcagcctctggctcaccgtcagcagcaactacatgagttgggtccgccaggctccagggaagcgggctggagtgggtctcagtcatttatactggtgatttcacatactacgcagactccgtgaagggccgattcaccatctccaggggacaattcccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccccatcggtcttccccctggcaccctccctccaagagcacctctgggggcacagcggccctggctgcctggtcaaggactacttcctatatactgtctgagcggcctggcaaggcgcatag

SEQ ID NO: 793909 - DNA, 594 bp, Homo sapiens
  misc_feature: 73725.UNK.UNK.UNK.pb.heavy.1.raw 73725
aggctggcaggctatgcaccctggtccaggtcaaagctgcggaacccgctagcggccatcttggccactaggggtcccgcagattcatattgtcgtctagcatgcacaatgctgcaaacccagctgcatgcccaagcaagcggccaatctttacgccacgttgaattgtttattacctgtgactggctatggcttgcaacgccactcgtaaaactagtacttgcggttaggggaagtagacaaaccattactccacttcccggaagttcactcatccaacacgaaataaaagtaactcaacacccaaagcaggctatgtgggggggtgataggggtggattctatttcctatcccatcccctaggatctcaattaagttactagcgagttaaatgtctgtagcgatcccgtcagtcctatcgcgcgcatcaagacctggtggttgagcgtgcagtagatcatcgtaagctgcgagttaggtcatcccagaccgcatctggcgcctaaacgttcagtggtagctaaggcgtccaccttcgactgtctaaaggcaatatgtcgtccttagctccaagtccctagcaggcgtgtcgg

SEQ ID NO: 793910 - DNA, 729 bp, Homo sapiens
  misc_feature: 73727.44.86.H09.1.pb.heavy.1.raw 73727
ctatgcgccttgccagcccgctcagacagtatataggaagtagtccttgaccaggcagcccagggccgctgtgcccccagagtgctcttggaggagggtgccaggggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaaatcgagcaccggtcgtgtatatactgtctgatggcgcgagggaggcgatacg

SEQ ID NO: 793911 - DNA, 640 bp, Homo sapiens
  misc_feature: 73731.44.12.B01.1.pb.heavy.1.raw 73731
ctatgcgcctgcgcccgctcagacagtatataggaagtagtccttgaccaggcagccagggccgctgtgccccagaggtgctcttggaggagggtgccaggggaagaccgagggccctggtggaggctgaggagacggtgaccagggtccctggccccagtggtcaaagtgttggtgacgactgcctactctcgcacagtaatacacggccgtgtccgcggcggtcacagagctcagctcagggagaacggttcttggacgtgttactgatatggtgactcgactcttgagggacgggttgtagtaggtgctcccactataatagatactcccaatccactccagccttccctgggggctggcggatccagcccagtagtaactactactgctgatggagccaccagagacagtgcaggtgagggacagggtcccgaaggcttcaccagtcctggcccgactcctgcagctgcagctgggacaggacccatctgggagccgccaccagcaggaggaagaaccacaggtgcttcatgtcttgcacaggaggtccatgactctcagaagccccgcggaatctacactactaaatcgagcaccggtcgtgtataactgtcgatggcgcgagggaggcgatacg

SEQ ID NO: 793912 - DNA, 704 bp, Homo sapiens
  misc_feature: 73742.44.67.G01.1.pb.heavy.1.raw 73742
cgtatcgcctccctcgcgccatcagacagtatatacacgaccggtgctcgatttagagtatacatattgggtttgggggggagaggaggcccagcactgggattccgaggtgtttccattcggtgatcagcactgaacacagaggactcaccatggagttttgctgagctgggttctccttgttggacttttaaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgccctccgcctccaccaagggccatcggtcttcccctggcaccctcctccaagagcacctctggggcacagcggccctgggctgcctggtcaaggactacttcctatatactgtctgagcgggctggcaaggcgcatag

SEQ ID NO: 793913 - DNA, 650 bp, Homo sapiens
  misc_feature: 73753.UNK.UNK.UNK.pb.heavy.1.raw 73753
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgcacggccccatagattgaaagaccagtccgcctcgcacagaaataaacggccgtgtccgcggcgggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttccgaaggcctcacattcctggcccgactcctgcagctgcacctgggacaggacccatctgggagctgccaccagcaggaggaaaaaccacaggtgcttcatgttcttgcacaggaggtcctgactctcagaaagcatcccaaacccaagttctatagcactaaatcgagccaccggtcgtggtatatactgtctgatggcgcgagggaggcgatacg

SEQ ID NO: 793914 - DNA, 655 bp, Homo sapiens
  misc_feature: 73760.44.86.H09.1.pb.heavy.1.raw 73760
ctatgcgccttgccagcccgctcagacagtatataggaagtagtccttgaccaggcagcccagggccgctgtgcccccagaggtgctcctggagcagggcgccagggggaagacgatggggccttggtggaagctgaggaacagtgaccagggtgccacggccccatagattgaaagaccagtctcgcctcgcacagaaataaacggccgtgtccgcggcggtcacgggaggtcagtttcagggagaagcggttcatggacgtgtcctcgaaatggtgagacgacttcttgagggacggagagtagtacgtcgcaccagtataaatggatgtcaccaatccactccattcccctccctggggctgccgatccagcccaagaatgatcagaactgatggaaaacccgagagacagtgcagaatgagagacagggttcccgaaggcctccaccagtcctgggcccgactcctgcagctgcacctgggacaggacccatctgggagctgccacccagcaggaggaaaaaccacaggtgcttcatgttctgcacaggaggtccttgactctcagaaagcatccccaaacccaagtctatagcactaaatcgagcaccggtcgtgtatatactgtctgatggcgcgagggaggcgatacg

SEQ ID NO: 793915 - DNA, 650 bp, Homo sapiens
  misc_feature: 73789.44.23.C01.1.pb.heavy.1.raw 73789
atcgcctccctcgcgccatcagacagtatatacacgaccggtgctcgatttagtacacgtgattagggattgggggctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactcccgtccctcaagagtcgtctcaccattttcgaggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtctttccccctggcgccctgctccaggagcacctctgggggcacagcggccctgggctgcctggtcaaggactacttcctatatactgtctgagcgggctggcaaggcgcatag

SEQ ID NO: 793916 - DNA, 698 bp, Homo sapiens
  misc_feature: 73793.44.36.D03.1.pb.heavy.1.raw 73793
ctatgcgccttgccagcccgctcagacagtatataggaagtagtccttgaccaggcagcccagggccgctgtgctctcggaggtgctcctggagcagggcgccagggggaagaccgatgggccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaaatgaaaacacctgggaattctgggctggggctccgctctcccccaagagagatcgtgacgcagctaaatcgagcaccggtcgtgtatatactgtctgatggcgcgagggaggcgatacg

SEQ ID NO: 793917 - DNA, 704 bp, Homo sapiens
  misc_feature: 73798.44.27.C05.1.pb.heavy.1.raw 73798
cgtatcgcctccctcgcgccatcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793918 - DNA, 734 bp, Homo sapiens
  misc_feature: 73821.44.86.H09.1.pb.heavy.1.raw 73821
cgtatcgcctccctcgcgccatcagacagtatatacacgaccggtgctcgattttagtgctatagacttgggttggggagctctgggagaggagccccagcaccagaagtcggcggtgtttccagtcggtgatcagccaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattattgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctggggggcacagcggccctgggctgcctggtcaaggactacttcctatatactgtctgagcgggctggcaaggcgcatag

SEQ ID NO: 793919 - DNA, 665 bp, Homo sapiens
  misc_feature: 73824.44.86.H09.1.pb.heavy.1.raw 73824
cgtatcgcctccctcggcgccatcagaccagtatatacacgaccggtgctcgattagtgctatagacttgggtttgggatgctttctgagagtcaaggggacctcctgtgcaagaacatgaagcacctgtggtttttcctcctgctggtggcagctccagatgggtcctgtcccaggtgcagctgcaggagtccggcccaggactggtgaggccttcgggaaccctgtctctcatctgcactgtctctggagtttccatcagttctgatcattcttggggctggatccggcagccccagggaggggaatggagtggattggtgacatccattatactgggggcgacgccgactactactctccgtccctcaagagtcgtctcaccatttcgagggacacgtccatgaaccgcttctccctgaaactgacctccgtgaccgcgccgcggacacggccgtttatttctgtgcgaggcgagactggtctttcaatctatggggccgtggcaccctggtcactgtctcctcagcttccaccaagggccccatcggtcttccccctggcgccctgctccaggagcacctctggggggcacagcggccctgggctgcctggtcaaggactacttcctatatactgtctgagcgggctggcaaggcgcatag

SEQ ID NO: 793920 - DNA, 693 bp, Homo sapiens
  misc_feature: 73828.UNK.UNK.UNK.pb.heavy.1.raw 73828
ctatgcgccttgccagcccgctcagacagtatataggaagtagtccttgaccaggcagcccagggccgctgtgctctcgaggtgctcctggaggcagggcgccagggaagaccgatggcccttggtgaggctgagggagacggtgaccagggttccctggccccagtggacagttcctgatataaacacaacacaataatacatgcccgtgtctcggttttcaggttatcatcgcagaatcaatgagttcttgaagtcatctcttgagagggtgaatctggctttcacagacgcggcgtactctgtgataaagctggcaactttgtttttactgcggccaagccactccagccccttccctggagcctggcgggacccagtccatatagtggtcactgatggtgaatccagaggcgacacaggagagtctcagggaccctcaggctggaccaagtctcccccggactcaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcaggctcccagagagatcgtgacgcagctaaatcgaaccggtcgtgtatatacttctgatggcgcgagggaggcggatacg

SEQ ID NO: 793921 - DNA, 683 bp, Homo sapiens
  misc_feature: 73835.44.27.C05.1.pb.heavy.1.raw 73835
cgtatcgcctccctcgcgccatcagacagtatatacacgaccggtgctcgatttagacgcgatcgaagggtttggggctgggagacgagcccagcactgaagtcgccggtgtttccactcggtgatcatcactgaacacagaggactcaccatggagtttggctgagctgggttttcctcgttgccctcttaagaggtgtcatgtgtcaggtgcaattcgtggagtctggggaggcgtggccccagtagggggtccctgagactctcctgtgcagcctctggattcaccttcgataattggaatatgcagtggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcggtcttccctggcgccctgctccaggagcacctccgagagcacagcggccctgggctgcctggtcaaggactacttcctatatactgtctgagcggctgg

SEQ ID NO: 793922 - DNA, 707 bp, Homo sapiens
  misc_feature: 73847.UNK.UNK.UNK.pb.heavy.1.raw 73847
ctatgcgccttgccagcccgctcagacagttataggaagtagtccttgaccaggcagccagggccgctgtgcccccagaggtgctcctgggagcagggcgccagggggaagaacgatgggcccttgtggaagctgaagagacggtgaccattgtccctggccccaaatattcaaatgcatcgacgtccaggatcgcctggcgcagtaatgacgcctgtgtcgtcggtctaggttgctcatttgtaaatggccaacactgttgggagtcatcccttgagacgggaatcttcccttcacagacgcggcgtactctttactttccacataacgtttcattctgacgaaagtgatccactcaagcccttccctggagcctgacggacccaggccaagtgataatcactaagactgaatcctgagactaccacaggagagtctcagagcacccgccctggctgtgccagccccccccgactccgccagtcgccctcgcactggacaccttctaaaaaaaaactacaaggaaaatcaagattagcccaaactccatggtttggtggtctgtgctcagtgctgatcaccaagtggaaactcctggaatctcacggctggggctcctctcccagagctcccctttgtgtgtcagacgtctgctaaatcgagcacggtcgtgtatatactgctgatggcgcgagggaggcgatacg

SEQ ID NO: 793923 - DNA, 714 bp, Homo sapiens
  misc_feature: 73855.44.36.D03.1.pb.heavy.1.raw 73855
cgtatcgcctccctcgcgccaatcagacagtatatacacgaccggtgctcgatttagctgcgtcacgatccttcttggggagctctgagagcggaagccccagccccagaattcccaggtgtttttcatttggtgatcagcactgaacacagaggatcaccatggagttcgggctgagctggggttttccttgttgttattttacaaggtgtccagagtgaaggtgcagttggtggagtccgggggagacttggtccagcctggaagggtccctgagactctcctgtgtcgcctctggattcaccatcagtgaccactatatggactgggtccgccaggctccagggaaggggctggagtggctttggccgcagtaaaaacaaagttgccagctttatccacagagtacgccgcgtctgtgaaagccagattcaccctcttcaagagatgacttcaagaactcattgattctgcgacatgactaacctggaaaaaccgagacaacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctgggcctgcctggtcaaggactacttcctataactgtctgagcggctggcaaggcgcatag

SEQ ID NO: 793924 - DNA, 643 bp, Homo sapiens
  misc_feature: 73906.44.19.B08.1.pb.heavy.1.raw 73906
gtatcgcctccctcgcgccatcagacagtatatacacgaccggtgctcgatttagtgagtcagtaaggggactcctgtgcccccaccatggacacactttgctccacgctcctgctgctgaccatcccttcatgggcctgtccagatcaccgtgaaagagtctggccctacattggtgaaacccacacagaccctcacgctgacctgcaccgtctcaggcttctcactcgtcactcctggagaagggcgttgtctgggtgcggcagccccccggaaaggccctggagtgatcgcactcacttattggaatgacgatatacgatatagtccttctctgacgaccagactcacgctcacgaaggacacgtccaaaaaccagggtgtccttacattgaccaacgtggaccctgtggacacaggcacatatttctgtgcccacttcatgaccacaatgaccacgggcttcttcgaaccctgggccagggaatccaggtcaccgtctcatcagcctccaccaagggcccatcggtcttccccctggcgccctgctccaggagccacctccgagagcacagcgcccctgggctgcctggtcaaggactacttcctatatactgtctgagcgggctggcaaggcgcatag

SEQ ID NO: 793925 - DNA, 698 bp, Homo sapiens
  misc_feature: 73916.44.36.D03.1.pb.heavy.1.raw 73916
tatgcgccttgccagcccgctcagacagtatataggaagtagtccttgaccaggccagcccagggcgctgtgctctcgaggtgctcctggagcaggcgccaggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagaggtgaatctggctttcacagacgcggcgtactctgtgataaagctggcaactttgtttttactgcggccagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctggggaattctgggctggggctccgctctcagagctccccaagagagatcgtgacgcagctaaatcgagcaccggtcgtgtatatactgtctgatggcgcgagggaggcgatacg

SEQ ID NO: 793926 - DNA, 698 bp, Homo sapiens
  misc_feature: 73950.44.27.C05.1.pb.heavy.1.raw 73950
cgtatcgcctccctcgcgccatcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtgagtctgggggaggcgtggccccagtagggggtcctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 793927 - DNA, 607 bp, Homo sapiens; identical to SEQ ID NO: 791738
  misc_feature: 73960.UNK.UNK.UNK.pb.heavy.1.raw 73960

SEQ ID NO: 793928 - DNA, 611 bp, Homo sapiens
  misc_feature: 73961.UNK.UNK.UNK.pb.heavy.1.raw 73961
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagaatcctaggggatgggaataggaaatagaatccacccctatcaccccccacatagcctgcttgggtgttgagtttactttttatttcgtgttggaatgagttgaacttccgggaagtggagtaatgggttttgtctacttcccctaaccgcaaagtactagtttttacgagtggcgttgcaagccatagccagtcacaggtaataaacaattcaacgtggcgtaaaagattggccgcctttgctgtgggcattgcaagctgggtttgcagcattgtgcatgctagacgacaatatgaatctgcgggacccctagtggccaagatggccgctagcgggttccgcagcttttgacctggaccaggtgcatagcctgcccagcct

SEQ ID NO: 793929 - DNA, 711 bp, Homo sapiens
  misc_feature: 73962.44.56.F01.1.pb.heavy.1.raw 73962
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgacattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttccttcaacagacgcgcgtactctttacttccaccataacgtttcattctgacgaaagtgatccactcaagccccttccctggagcctgacggacccaggcaagtgataatcacttagactgaatcctgagactacacaggagagtctcagagaccgccctggctgtgccagccccccccccgactccgccagtcgcccctcgcactggacaccttctaaaaaaaactacaaggaaaatcaagattagcccaaactccatggttggtggtctgtgctcagtgctgatcaccaagtggaaactcctgggaatctcacggctgggggcttcctctcccagagctcccctttgtgtgttcagacgtctgctaaatcgagcaccggtcgtgtattgtctgatggcgcgagggaggcgatacg

SEQ ID NO: 793930 - DNA, 724 bp, Homo sapiens
  misc_feature: 73965.44.86.H09.1.pb.heavy.1.raw 73965
cgtatcgcctcctcgcgccatcagacagtatatacacgaccggtgctcgatttagtgctatagacttgggttggggagctctgggagaggagcccagcaccagaagtcggcggtgtttccagtcggtgatcagcacgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactcaatggtatggacgcctggggccaagggaccacggtcgccgtctcctcagcctccaccaagggcccatcggtcttccccctggcaccctcctccaagagcacctctgggggcacagcggccctggctgcctggtcaaggactacttcctatatactgtctgagcgggctggcaaggcgcatag

SEQ ID NO: 793931 - DNA, 642 bp, Homo sapiens
  misc_feature: 73977.UNK.UNK.UNK.pb.heavy.1.raw 73977
ctatgcgccttgccagccgctcagacagtatataggaagtagtccttgacaggcagcccagggccgctgtgcccccagagtgctcctggagcagggcgccaggggaagaccgatgggcccttggtggaagctgaggagacagtgacagggtgccacggccccatagattgaaagaccagtctcgctcgccagaaataaacggccgtgtccgcggcggtcacggaggtcagtttcagggagaagcggttcatggacgtgtccctcgaaatggtgagacgactctgaggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagcctgcacctgggacaggacccatctgggagctgccaccagcaggaggaaaaacacaggtgcttcatgttcttgcacaggagtccttgactctcagaaagcccacaatccctaatcacgtgtactaaatcgagcaccgtcgtgtatatactgtctgatggcgcgagggaggcgatacg

SEQ ID NO: 793932 - DNA, 654 bp, Homo sapiens
  misc_feature: 73979.44.86.H09.1.pb.heavy.1.raw 73979
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793933 - DNA, 686 bp, Homo sapiens
  misc_feature: 73993.UNK.UNK.UNK.pb.heavy.1.raw 73993
ctatgcgccgcttgccagccggccgctcagacagtatatacaggaagtagtccttgaccaggcagccagggcgcgctgtgccccagaggtgctcctggagcagggcgccaggggaagaccgatgggcccttggtgaagctgaggagacagtgaccagggtgccacggccgccccatagattgaaagaccagtctcgcctcgcacagaaataaacgggcgtgtccgcggcggtcacggaggtcagtttcagggagaagcggttccatggaggtgttccctccgaagatggtgagcagcgactcttgagggacggagagtagtacgtcgccccgccgcggtcatacatggatgtcaccaatccactccattccgccctcgccggggctgccggatccagccccaagaatggatcgagaactgatggaaactccagagacagtgcagatgagagaacaggttcccgaagggcctcaccagtcctggccccgcgactcctgcagctgcacctgggacaggacccatctgggagctgccaccaggcaggaggaaaaaccacaggtgcttcatgtgttctgcggcaggaggctccttgactctcagaagcccccaatccctaatgcacgtgtactaaatcgagcaccggtcgtgtatactactgtcctcgatggcgcgagggaggcgatacg

SEQ ID NO: 793934 - DNA, 619 bp, Homo sapiens
  misc_feature: 73998.UNK.UNK.UNK.pb.heavy.1.raw 73998
cccgaacacgcttgctagggacttggagctaaggacgacatattgcctttagacagtcgaaggtgacgccttagctaccactgacgtttaggcgccagatgcggttctgggatgacctaactcgcagcttatcgatgatctactgcacgctcaaccaaccaggtcttgatgcgcgcgataggactgacgggatcgctacagacatttaactcgctaggtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaaccgcaaagtactagttttacgagtggcgttggcaagccataggccagtcacaggtaataaacaatttcaacgtggcgtaaagatttggcccgcttgctgtgggcattgcaagctggtttgcagcattgtggcatgctagacgacaatatgaatctgcgggacccctagtggccaagatggcccgctagcgggttccgcagcttttggacctgggaccagggtgcatagcctgcccagccttc

SEQ ID NO: 793935 - DNA, 655 bp, Homo sapiens
  misc_feature: 74009.44.23.C01.1.pb.heavy.1.raw 74009
cgtatcgcctccctcgcgccatcagtctatactatcacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggaactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggggccgttggcaccctggtcactgtctcctcagcttccaccaagggcccatcggtcttccccctggcgccctgctccaggagcacctctgggggcacagcggccctgggctgcctggtcaaggactacttccttatactgtctgagcgggctggcaaggcgcatag

SEQ ID NO: 793936 - DNA, 702 bp, Homo sapiens
  misc_feature: 74012.44.27.C05.1.pb.heavy.1.raw 74012
cgtatcgcctcctcgcgccatcagacagtatatacacgaccggtgctcgatttagacgcgatcgaaggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacgccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793937 - DNA, 714 bp, Homo sapiens
  misc_feature: 74014.UNK.UNK.UNK.pb.heavy.1.raw 74014
ctatgcgccttgccagccgctcagacagtatataggaagtagtccttgaccaggcagcccagggccgctgtgccccagaggtgctcttggaggagggtgccaggggggaagacgatgggcccttggtggaggcggaggcgacggtgaccagggttccctggccccagaagtcaaacgaataataacccactccgagcgccgacttgtctcgcacagcaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctggacccccccaggctggactaagcctcctccagactccatcagccgcacctccacactggacaccttttaaaagtccaacaaggagaacccagctcagccaaaactccatggtgagtccctctgtgttcagtgcctgatcaccgaatggaaacacctcggaatcccgagtgctgggctcctctccccccccaaacccaaccgtgcgagtgctaaatcgagccgccggtccgtgtatatactgtctgatggcgccgagggaggcgatacg

SEQ ID NO: 793938 - DNA, 696 bp, Homo sapiens
  misc_feature: 74020.44.36.D03.1.pb.heavy.1.raw 74020
atcgcctccctcgccgccatcagacagtatatacacgaccggtgctcgatttagctgcgtcacgatctctctggggagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctccttgtgtcgcctctggattcaccatccagtgaccactatatggactgggtccgccaggctccagggaagggctggagtggcttggccgcagtaaaaacaaagttgccagctttatcacagagtacgccgcggtctgtgaaagccagattcaccctctcaagagatgacttcaagaactcattgattctgcgaatgactaacctgaaaaaccgaggacacgggcatgtattattgtgttgtatttatatcaggaactgtccactggggcccagggaaccctggtcaccgtctcctcagcctccaccaagggcccatcggtcttcccctggcgccctgctccaggagcacctccgagagcacagcggccctgggctgcctggtcaaggacacttcctatatactgtctgagcgggctggcaaggcgcatag

SEQ ID NO: 793939 - DNA, 698 bp, Homo sapiens
  misc_feature: 74035.44.27.C05.1.pb.heavy.1.raw 74035
ctatgcgcctgccagcccgctcagacagtatataggaagtagtccttgaccaggcagcccaggccgctgtgctctcggaggtgctcctggagcagtgcgccagggggaagaccgatgggcccttggtggaggccgaggagacggtgaccagggttccctggcccaggcgtcgaatgaaccgattttggaaacagatagtctcgcacaaaatacacgccgtgtcctgaggtctcaggctgttcatttgaagagacactgtgttctcggaattgtctctggagatggtgaatcggccctcaacggaatcaccgtagacttgatttcctccatgaaatgaccacacctgccacccactccagccctcgcctggagcctggcggacccactgcatattccaattatcgaaggtgaatccagaggctgcacaggaagtctcagggacccccctactggggccacgcctccccagactccacgaattgcacctgacacatgacacctcttaagagggcaacgaggaaaacccagctcagccaaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 793940 - DNA, 605 bp, Homo sapiens
  misc_feature: 74045.UNK.UNK.UNK.pb.heavy.1.raw 74045
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgatagggtggattctatttcctatccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 793941 - DNA, 616 bp, Homo sapiens
  misc_feature: 74049.UNK.UNK.UNK.pb.heavy.1.raw 74049
cccgacacgcttgctagggacttggagctaaggacgacatattgccctttagacagtcgaaggtgacgccttagctaccactgaacgtttaggcgccagatgcggtctgggatgacctaactcgcagcttatcgatgatctactgcacgctcaaccaaccaggtcttgatgcggcgcgataggactgacgggatcgctacagacatttaactcggctagtaacttaattgagattcctaggggatgggataggaaatagaatccacccctatcacccccccacatagcctgctggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattgggccgctgctgtggggccattgcaagctgggtttgccagcattgtgcatgctagacgacaatatgaatcctgcgggacccctagtggcccaagatggccgctagcgggttccggcagcttttgacctggaccagggtgcatagcctgccagccttc

SEQ ID NO: 793942 - DNA, 726 bp, Homo sapiens
  misc_feature: 74051.UNK.UNK.UNK.pb.heavy.1.raw 74051
ctatgcgccttgccagccgctcagacagtatataaggaagtagtcccttgaccaggcagcccagggcccgctgtgctctcggaggctgctcctggagcagggcgccaggggaagaccgatgggcccttggtggaggccgagagacggtgaccagggttccctggccccaggcgtcgaatgaaccgattttggaaacagatagtctcgcacaaaaatacacggccggtgtcctgaggtctcaggctgttcatttgaagagacactgtgttctcggaattgtctctggagatggtgaatcggccctcaacggaatcaccggtagacttgatttcctccatgaaatgacacacctgccacccactccagcccctcgcctggagcctgggcggacccactgcatattccaattatcgaaggtgaatccagaggctgcacaggaggagtctcagggaccccccctactgggccacgccctcccccagactccacgaattgcacctggacacatgacacctcttaaggagggcaacgaggaaaaacccagctcagcccaaactccatggtgagtcctctgtgttcagtgatgatcaccgagtggaaaaccaccgcgacttccagttgcggctcgtctccccagggctccccaaaacccttcgatcgcgtctaaatccgagccaccggtccgtggtatatactggtcctggagtggcgcgaggaggcgatacg

SEQ ID NO: 793943 - DNA, 560 bp, Homo sapiens
  misc_feature: 74052.UNK.UNK.UNK.pb.heavy.1.raw 74052
ctatgcgccttgccaggcccgctcagacagtatataggaagtagtccttgaccaggcaggccccagggccgctgtgcccccagaggtggctcctggagcagggcgccagggggaagaccgatgggcccttggtggaagctggaggagacggtgaccgtggtcccttggccccagacgtccataccgtagtagtagtatgccaactccccgaactcccgcaccggcttcttgcacagtaatacacagccgtgtcctcggctctcagactgttcatttgcagatacagcgtgttcttggcgttgttctctggagatggtgaatcggcccttcacggagtccgcgtagcttgtggctactcccatcactattaatacgtgagacccacaccagcccccttccctggagcttggcggacccagtggcaatccagtagcctactgaaggtgaatccagaggctgcacaggagagtctcagggaccgcccaaacccaactatcagatactaaaatcgagtaccggtcgtgtatatactgtctgatggcgcgagggagggcgatacg

SEQ ID NO: 793944 - DNA, 572 bp, Homo sapiens
  misc_feature: 74059.UNK.UNK.UNK.pb.heavy.1.raw 74059
cgtatcgccctccctcgcgccatcagacagtatatacacgacggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagttagtatgaccaggagcacacctcccaggtacagtctacatggaactgagcagcctgagatctgagggacacggccgtgtatttctgtgcgagagccaccagccacctggttgacttgtggggccagggaaccctggtcacgtctcctcagcctccaccaagggcccatcggtcttcccctggcgcctgctccaggagcacctccgagagcacagcggccctgggctgcctggtcaagggactacttcctatatactgtctgagcgggctggcaaggcgcatag

SEQ ID NO: 793945 - DNA, 703 bp, Homo sapiens
  misc_feature: 74064.44.36.D03.1.pb.heavy.1.raw 74064
cgtatcgcctccctcgcgccatcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggtttccttgttgctattttagaaggtgtccactgtgaggtgcggctggtggagtctgggggaggcttggtacagcggggggggtcctgagactctcctgtgcagcctctggattcatcttcagtgactatgccatgaactgggtccgcaggctccaggaagggctggagtgggtttcatatgttaatattgttggagataccacctactacgcagactctgtgaagggccgattcaccaattccagggacaatgccaagaactcactgtatctggaaatgaacagcctgagagacgaggacacggctgtctacttctgttcgagagatcgggccacttggtcagtggctggttttgactactgggggcgggaaccctggtcaccgtctcctcagcctccaccaagggccatcggtcttcccctggcgccctgctccaggagcacctcgagagcacagcggccctgggctgcctggtcaaggactacttcctatatactgtctgagcgggctggcaaggcgcatag

SEQ ID NO: 793946 - DNA, 571 bp, Homo sapiens
  misc_feature: 74073.44.78.H01.1.pb.heavy.1.raw 74073
cgtatcgcctcctcgcgccatcagacagtatatacacgaccggtgctcgatttagtgtgagtagtttgggtttgggtgccgaagttgctggaggtcacggtcaccacgctgctgaggtgaagaagcctgggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 793947 - DNA, 717 bp, Homo sapiens
  misc_feature: 74127.44.36.D03.1.pb.heavy.1.raw 74127
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtctggggaggcttggtacagcggggggggggtccctgagactctcctgtggcagcctctggattcatcttcagtgactatgccatgaactgggtccgccaggctccagggaaggggctggagtgggtttcatatgttaatattgctggagataccacctactacgcagactctgtgaaggggccgattcaccaattccagggacaatgccaagaactcactgtatctggaaatgaacagcctgagagacgaggacacggctgtctacttctgttcgagagatcgggccacttggtcagtggctggttttgactactggggccggggaaccctggtcaccgtctcctcagcctccaccaagggcccatcggtcttccccctggcgcccctgctccaggagcacctccgagagcacagcggccctgggctgcctggtcaaggactacttcctatatactgttctgagcgggctggcaaggcgcatag

SEQ ID NO: 793948 - DNA, 604 bp, Homo sapiens
  misc_feature: 74150.UNK.UNK.UNK.pb.heavy.1.raw 74150
aaccacattcctcctctaaagagcccctgggagcacagctcatcaccatggactggacctggaggttcctctttgtggtggcagcagcaacaggtgtccagtccctggtgcaactggtgcagtctgggactagaatgccgcaacctggtcctcggtgaccctttcctgcacggcctctggaagtactaccagttccactacttataccatcaactggtgcgccaggcccctggacaagggcttgagtggatgggtggaaatcatccctcttttggctcactcacctacgcacgagacttccgggcagaaattacgattaccggcgacaagtccacagacacagtctccatgacaatgagttctttgaaatccgacgacacggcccgtctactactgtgcgagaggtccgtaccccagctcgcatgagcctttgagatctgggggcagggaaccctggtcattgtcaccttcagcttccaccaagggcccatcggtcttcccctggcgccctgctccaggagcactctggggcacagcggcctgggctgcctggtcaaggactacttcctatatactggtctgagcgggctggcaaggcgcatag

SEQ ID NO: 793949 - DNA, 709 bp, Homo sapiens
  misc_feature: 74166.44.36.D03.1.pb.heavy.1.raw 74166
ctatgcgccttgccagcccgctcagacagtatataggaaagtagttccttgaccaggcagcccagggccgctgtgcccccagaggtgctcctggagcagggcgccaggggaagaccgatgggcccttggtggaagctgaggagacggtgaccgtggtccctttgccccagacgtccatgtagtagtaatagtagaaggagtagctcccgcccactctcgcacagtaatatacggccgcgtcctcggctctcaggctgctcaattgaagatacaccgtattcttggacttgtctctggagatggtgaatcggcccttcacggagtctgcgtagtatgtcccaccaccggtattaatacctgagacccactccagccccttcccggagcctggcggacccagctcatgtagtagctgctgacggtaaagccagaggctgcacaagagagtctcagggactccccaggctggatcaaacctcctccagactccaccagttgcacctcacactggacaccttttaaaatagcaacaaggaaaacccagctcagccaaaactccatggtgagtcctctgtgttcagtgctggtcaccgaatggaaacacctcggaatccagtgctgggctcctctcccccaagagagatcgtgacgcagctaaatcgagcaccggtcgtgtatatactgtctgatggcgcgaggaggcgatacg

SEQ ID NO: 793950 - DNA, 667 bp, Homo sapiens
  misc_feature: 74181.UNK.UNK.UNK.pb.heavy.1.raw 74181
ctatgcgccttgccagcccgctcagacagtatataggaagtagtcttgaccaggcagcccagggccgctgtgctctcggaggtgctcctggagcagggcgccaggggagaccgatgggccttggtggaggctgaggagacggtgaccagggttccctggcccgaatgaaaccatccagacagtaatagacggctgtgtcctcggtgttcaggctgttcatctgcagagacaccgtatcttttgaatcatctcttgagatggtgaatctgcctttcacgggtgcagcgtagtctgctgtcccaccgtcagcttggttctaatacggccaacccacccagccccttcctggagcctggcggacccaggtcatccaggcgttactgaaagtgaatccagaggcgcacaggagagtctaagggactccccaggcttaccaaacctccccagactccaccaactgcactcacactggacaccttttaaatagcagcaaggaaaatccagctcagcccaaactccatggtgagtcctctgtgttcagtcctgatcactgaatgaaaacacctgggaatcccaaggctggggctcctctcccagctcaacacactctctctaaatcgagcccggtcgtgttatactgtcctgatggcgcggagggagcgatacg

SEQ ID NO: 793951 - DNA, 675 bp, Homo sapiens
  misc_feature: 74182.44.38.D05.1.pb.heavy.1.raw 74182
cgtatcgcctccctcgcgccatcagacagtatatacacgaccggtgctcgatttagtatctgatagtttgggtttgggggggaagaggaagactgacggtcctcccaggagttcaggtgctgggcaccttggggcacggggaggtgtgtcacaagatttgggctctgggcaccgtgggcatgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcgggactccgtgaagggccgattcaccatctccagagacaacgccaagaacacgctgtatctgcaaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggccatcggtcttcccccctggcgccctgctccaggagcacctctgggggcacagcggccctgggctgcctggtcaaggactacttcctatatactgtctgagcgggctggcaaggcgcatag

SEQ ID NO: 793952 - DNA, 702 bp, Homo sapiens
  misc_feature: 74186.44.55.E11.1.pb.heavy.1.raw 74186
ctatgcggccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttcctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccccttccctggagcctggcggacccaactcatgtagttgctgctgacggtgagcccagaggctgcacaggagagtctctgggaccccccaggctggactaagcctcctccagactccatcagccgcacctcacactggacacctttaaaagtccaacaaggagacccagctcagccaaaactccatgtgagtcctctgtgttcagtgctgatcaccgaatggaaacacctcggaatcccagtgctgggctccctccccccaaacccaacgtgcgagtgctaaatcgagcaccggtcgtgtatatactgtctgatggcgcgagggaggcgatacg

SEQ ID NO: 793953 - DNA, 708 bp, Homo sapiens
  misc_feature: 74191.UNK.UNK.UNK.pb.heavy.1.raw 74191
ctatgcgccttgcagcccgctcagacagtatataggaagtagtcctttgaccaggcagcccagggccgctgtgctctcgaggtgctcctggagcagggcgccagggggaagaccgatggccccttgtggaggctgaagagacggtcaccactgtccccggcccaagtactaaaggtgtcatggggggtcaccgtggtcctggctttcaaacagtaatagacgcctgtgtcctcgggtctcaggtttttcattttggagaacaatttgtcctgcgaattgtccctggaaatggtgaagcggcccttcacggagtctccgtagaagtgacaccacacagctcgatacttgagacccactccagtccctccctggagcccggcggacccaggtcatgccataggcactaaaggtgaatccagaggccgcacaggagagggtcagggacctcccaggccgaatcaggccccccccagactccaacaactgcactttcacacacgacaccctttaaaaaagcccacaagaaaaaaggcagctcagcccaaactccatggagacttctctctgttcggtcctggtcaccaaatgaagaccctgaaaatcccaggctgggctcctctctcagagctccctttccctttatgcgactactaaatcgggcacggtcgtgtatgatatactgtctgatgccgcgagggaggcgatacg

SEQ ID NO: 793954 - DNA, 623 bp, Homo sapiens
  misc_feature: 74209.UNK.UNK.UNK.pb.heavy.1.raw 74209
cgtatcgcctccctcgcgccatcagctctatactatccacgaccggtgctcgatttagtacaccgtgattagggattcggggcagggtgaacacctgtggtttttcctcctgctggtggcagctcccagactgggtcctgtccaggtgcagctgcaggagtcgggcccagactggtgaggccttcgggaaccctgtcctcatctgcactgtctctggagtttccatcagttctgatcattcttggggctggatccggcagccccaggaggggaatggagtggattgggtgaccatccattatactgggggcgacgtactactctccgtccctcaagagtcgtctcacatttcgagggacacgtccatgaccgcttctccctgaaacactgacctccgtgaccgccgcggacacggccgtttatttctgtgcgaggcgagactggtctttcaatctatggggccgtggcacccctggtcactgtctcctcagcttccaccaaggcccatcggtcttcccctggcgccctgctccaggagcacctctgggggcacagcggccctgggctgcctggtcaaggactacttcctatatactgtctgagcgggctgcaagggcgcatag

SEQ ID NO: 793955 - DNA, 657 bp, Homo sapiens
  misc_feature: 74214.44.86.H09.1.pb.heavy.1.raw 74214
ctatgcgccttgccagcccgctcagacagtatataggaagtagtccttgaccaggcagcccagggccgctgtgcccccagaggtgctcctggagcagggcgccaggggggaagaccgatgggcccttggtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacaggggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 793956 - DNA, 688 bp, Homo sapiens
  misc_feature: 74221.UNK.UNK.UNK.pb.heavy.1.raw 74221
cgtatcgcctcctcgcgccatcagacagtatatacacgaccggtgctcgatttaggtagctctatcagggggagctcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacctggtcctcggtgacccttcctgcacgctctggaagtactaccagttccactacttataccatcaactgggtgcgccaggccctggacaagggcttgagtggatgggtggaatcatcctctttttggctcactcacctacgccacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 793957 - DNA, 666 bp, Homo sapiens
  misc_feature: 74234.44.23.C01.1.pb.heavy.1.raw 74234
ctatgcgccttgccagcccgctcagacagtatataggaagtaagtccttgaccaggccagcccagggccgctgtgcccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcgcggcggtcacgggaggtcagtttcaggagaagcggttcatggacgtgtcccctcgaaatggtgagacgactcttgagggacggagagtagtacgtccgccccagtataataatggatgtgtcaccaatccactccattcccctccctgggggctgccggatccagccccaagaatgatcagaactgatggaaactccagagacagtgcccagatgagagacagggttcccgaaggcctcaccagtcctgggccgactcctgcagctgcacctgggacaggaccatctgggagctgccaccagcaggaggaaaaaaccacaggtgcttcatgttcttgcacaggaggtccttgactctcagaaagcccccaatccctaatcacgtgtactaaaatcgagcaccggtcgtgtatatactgttctgatggcgcgaaggaggcgatacg

SEQ ID NO: 793958 - DNA, 709 bp, Homo sapiens
  misc_feature: 74236.44.62.F07.1.pb.heavy.1.raw 74236
ctatgcgccttgccagcccgctcagacagtatataggaagtagtccttgaccaggcagcccaggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagaccactccagtcccctccctggagcccggcggacccaggtcatgccataggcactaaaggtgaatccagaggccgcacaggagagggtcagggacctcccaggccgaatcaggccccccccagactccaacaactgcacttcacacacgacaccctttaaaaaagccacaagaaaaaggcagctcagcccaaactccatggagacttctctctgttcggtcctggtcaccaatgaagacacctgaaaatcccagggctgggctcctctctcagagctcccctttccctttatgcgactactaaaatcgagcaccggtcgtgtatatactgtctgatggcgcgagggaggcgatacg

SEQ ID NO: 793959 - DNA, 622 bp, Homo sapiens
  misc_feature: 74248.44.23.C01.1.pb.heavy.1.raw 74248
ctatgcgccttgccagcccgctcagacagtatataggaagtagtccttgaccaggcagcccagggcccgctgtgcccccagaggtgctcctgagcagggcgccagggggaagaccgatggcgcccttggtggaagctgaggagacagtgaccagggtgccacggcgccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaaagaatgatcagactgatggaaactccagagacagtgcagatgagagacagggttccgaaggcctcaccagtcctgggcccgactcctgcagctgcacctgggacggacccatctgggagctgccaccagcaggaggaaaaaccacaggtgttcaccctgccccaatccctaatcacgtgtactaaatcgagcaccggtcgtgtatatactgtctgatggccgcgagggaggcgatacg

SEQ ID NO: 793960 - DNA, 699 bp, Homo sapiens
  misc_feature: 74257.44.36.D03.1.pb.heavy.1.raw 74257
cgtatcgcctcctcgcgccatcagacagtatatacacgaccggtgctcgatttagctgcgtcacgatctctcttggggagctctgagagcggagccccagccccagaatcccaggtgttttcatttggtgatcagcactgaacacagaggactcaccatggagttcgggctgagctgggttttccttgttgttattttacaaggtgtccagagtgaagtgcagttggtggagtcgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcgtcttccccctggcgccctgctccaggagcacctccgagagcacagcggccctgggctgcctggtcaggactacttcctatatactgtctgagcgggctggcaaggcgcatag

SEQ ID NO: 793961 - DNA, 724 bp, Homo sapiens
  misc_feature: 74271.UNK.UNK.UNK.pb.heavy.1.raw 74271
ctatgcgccttgccaggcccgctcagacagtatataggaagtagtccttgaccaggcagcccagggccgctgtgccccagaaggtgctcttggaggagggtgccagggggaagaccgatgcggcccttggtggaggcggaggcgacggtgaccaggggttccctggccccagaagtcaaacgaataataaccactccgagcgccgacttgtctcgccacagtaatagacggccgtgtcgtcgcctctcaggttgttcatttgaagaatacaaccgtgttcctggaattgtccctggagaatggtgaatcggcccttcacggagtctgcgtagtatgtgaaatcacagtataaatgactgagacccactccagccccttcccctggagcctgggcggacccaactcaatgtagttgctgctgacggtgagcccagaggctgcacaggagagtctctggggaccccccaggctggactaagctcctccagactccatcagccgcacctcacactggacacctttaaaagtccaacaaggagaacccagctcagccaaaaactccatggtggagtcctctgtgttcagtgctgatcaccgaatggaaacacctcggaatcccagtgctggggctcctctcccccccgcaaaacccaacgtgcgagctgctaaatcgagccagccgggtcgtgtatatactggtctgatggcgcgaggaggcgatacg

SEQ ID NO: 793962 - DNA, 593 bp, Homo sapiens
  misc_feature: 74279.44.78.H01.1.pb.heavy.1.raw 74279
ctatgcgccttgccagcccgctcagacagtatataggaagtagtccttgaccaggcagccagggccgctgtgctctcggaggtgctcctggagcagggcgccaggggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgagggccccaggcttcttcacctcagccccagactgcaccagctgtacctgggagtgggaccgtcagtcttcctcttccccccaaacccaaaactactcacactaatcgagcaccggtcgtgtatatactgtctgatggcgcgagggaggcgatacg

SEQ ID NO: 793963 - DNA, 728 bp, Homo sapiens
  misc_feature: 74288.44.33.C11.1.pb.heavy.1.raw 74288
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattgagtagagcatgtcatatctgtatccacgagcccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtatatactgtctgatggcgcgagggaggcgatacg

SEQ ID NO: 793964 - DNA, 701 bp, Homo sapiens
  misc_feature: 74298.44.27.C05.1.pb.heavy.1.raw 74298
ctatgcgccttgccagcccgctcagacagtatataggaagtagtccttgaccaggcagcccagggccgctgtgctctcggaggtgctcctggagcagggcgccaggggaagaccgatgggcccttggtggaggccgaggagacgtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 793965 - DNA, 645 bp, Homo sapiens
  misc_feature: 74303.UNK.UNK.UNK.pb.heavy.1.raw 74303
cgtatcgcctccctcgcgccatcagacagtatatacacgaccggtgcccgatttagtgagtcagtaaggggactcctgtgccccaccatggacacactttgctccacgctcctgctgctgaccatcccttcatgggcctgtcccagatcaccgtgaaagagtctggccctacattggtgaaacccaccacagaccctcacgctgacctgcaccgtctcaggcttctcactcgtcactccctggagagggcgttgtctggtgcggcagcccccggaaaggccctggagtgggatcgcactcacttattggaatgacgatatacgatatagtccttctctgacgaccagactcacgctcacgaaggaccacgtccaaaaaccaggtggtcctacattgaccaacgtgaccctgtggacacaggcacatatttctgtgcccacttcatgaccacaatgaccacgggcttcttcgaaccctggggccaggaatccaggtcaccgtctcatcagcctccaccaagggccatcggtctttccccctggcgccctgcttccaggagcacctccgagagcacagcggccctgggctgcctggtcaaggactacttcctatatactgtctgagcgggctggcaagggcgcatag

SEQ ID NO: 793966 - DNA, 669 bp, Homo sapiens
  misc_feature: 74321.44.12.B01.1.pb.heavy.1.raw 74321
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgcccctactctcgcacagtaatacacggccgtgtccgcggcggtcacagagctcagcttcagggagaactggtttcttggacgtgtctactgatatggtgactcgactcttgaggggacgggttgtagtaggtgctcccactataatagatactcccaatccactccagccccttccctgggggctggcggatccagccccagtagtaaactactactgctgatggagccaccagagacagtgcaggtgagggacagggtctccgaaggcttcaccagtcctgggcccgactcctgcagctgcagctgggacaggaaccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 793967 - DNA, 696 bp, Homo sapiens
  misc_feature: 74353.44.36.D03.1.pb.heavy.1.raw 74353
gtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctggttttccttgttgttattttacaaggtgtccagagtgaagtgcagttggtggagtccggggagacttggtccagcctggaggtccctgagactctcctgtgtcgcctctggattcaccatcagtgaccactatatggactgggtccgccaggctccagggaaggggctggagtggcttgccgcagtaaaaacaaagttgccagctttatcacagagtacgccgcgtctgtgaaagccagattcaccctctcaagagatgacttcaagaactcattgattctgcgaatgactacctgaaaaccgaggacacggcatgtattattgtgttgtgtttatatcaggaactgtccactggggccaggaaccctggtcaccgtctcctcagcctccacccaagggcccatcggtcttccccctggcgccctgctccaggagcacctccgagagcacagcggccctggctgcctggtcaaggactacttcctatatactgtctgagcggctggcaaggcgcatag

SEQ ID NO: 793968 - DNA, 701 bp, Homo sapiens
  misc_feature: 74363.UNK.UNK.UNK.pb.heavy.1.raw 74363
tgcgccttgccagcccgctcagacagtatataggaaagtagtcctgacaggcagcccaggcgctgtgccccagaggtgctcttggaggagggtgccagggggaagaccgatggccttggtggaggcggaggcgacggtgaccagggttccctggccccagaagtcaaacgaataataaccactcccgagcgccgacttgtctcgcacagtaatagacggccgtgtcgtcgccctctcaggttgttcattgaagataaaccgtgttcctggaatgtccctggaggatgggtgaatcgcccttcacggagtctgcgtagtatgtgaaatcaccagtataaatgactgagacccactccagcccgcttcctggagcctggcggacccaactcatggtgtagttgctgctgacggtgagcccagaggctgcacaggagagtctctgggacccccaggctggactaagcctcctccagactccatcagccgcacctcacactggacaccttttaaaagtccacaaggaagaacccagctcagccaaaactccatggtgaggtctctgtgttcagtgctgatcaccgaatggaaacaccttcggaatcccagtgctgggctcctctccccccaaacccaacgtgcgagtgctaaatcgagcaccggttcgtgtatatactgtctgatggcgcgagggaggcgatacg

SEQ ID NO: 793969 - DNA, 674 bp, Homo sapiens
  misc_feature: 74381.UNK.UNK.UNK.pb.heavy.1.raw 74381
cgtatcgccctccctcggcgccatcagacagtatatacacgaccggtgctccgatttagagagagtgtgttttgggtttgggggaagcacctgtggttcttctctcctggctggtggcggctccccagaatgggtcctgtctcagccgcagctgcggggagtcggggcccaggactggtgaagccttcggacccgtgtccctgcacgtgcacggtctctggtgcctccatcgacagaagtaatttctactgggggctggatccgccagcccccaggagaggggctgcagtggattgggagtctctattatagtgggaacacctactaccaacccgtccctccaacggtcgagtccaccatatccgtggacacgtcgaggacacagtttccctgaaagtgagttctgtggccgccgccgacacggctgtctactactgtgtcagacatgggtccgcctatggcaggtcgtctcaattctactacgcttgggacgtctggggccaaggacgcacggtcaccgtctcctcatcctcagcctccaccaaggcgccatcggtcttcccctggcgccctgcctccaggagcacctccgagagcacagcggccctggggcctgccctgggtcaaggactacttcctatatactgtctgagcgggctggcaagggcgcatag

SEQ ID NO: 793970 - DNA, 712 bp, Homo sapiens
  misc_feature: 74398.44.55.E11.1.pb.heavy.1.raw 74398
ctatgcgcccttgccagcccgctcagacagtatataggaagtagtgccttgaccaggccagcccagggccgctgtgcccccagaggtgctcttggaggagggtgccagggaagaccgatggcccttggtggaggggggaggcgacggtgaccagggttccctggccccagaagtcaaacgaataataaccactccgagcgccgacttgtctcgcacagtaatagacggccgtgtcgtcgcctctcagggttgttcatttgaagataaaacgcgtgttcctggaattgtccctggagatggtgaatccggcccttcacggagtctgcgtagtatgtgaaatcaccagtataaatgactgagacccactccagccccttccctggagcctggcggaccaactcatgtagttgctggctgacggtgagcccagagctgcacaggagagtctcctgggacccgccaggctggactaagcctcctccagactccatcagccgcacctcacactggacaccttttaaaagtccaacaaggagaaccccagctcagccaaaactccatggtgagtcctctgtgttcagtgctgatcaccggaatggaaacacctcggaatccagtgctgggctcctctcccccccaaacccaacgtgcgagtgctaaatcgagcaccggtcgtgtatatactgtctgatggcgcgagggaggcgatacg

SEQ ID NO: 793971 - DNA, 700 bp, Homo sapiens
  misc_feature: 74408.44.71.G05.1.pb.heavy.1.raw 74408
cgtatcgcctccctcgcgcgccatcagacagtatatacacgaccggtgctcgatttagtgtcgtcgcaagagagagggagccccagccgtgagattccccaggagtttccactggtgatcagcactgagcacagaccaccaaccatggcagtttgggctaatcttgattttccttgtagtttttttagaaggtgtccagtgcgaggggcgactggcgggagtcgggggggggcttggcacagccagggcggtctctgagactctcctgtgtagtctcaggatcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaaggatgactccaacagtgttggccatttacaaatgagcaacctgagacccgacgacacaggcgtctattactggcgccaggcgatcctgggacgtcgatgcatttgatatttgggggccaggcggacaatggtcaccgtctcttcagcttccaccaagggcccatcggtcttccccctggccgccctgctccaggagcacctctgggggcacagcggccctgggctgcctggtcgaaggactacttccctatatactgtctgagcggcgctggcaaggc

SEQ ID NO: 793972 - DNA, 704 bp, Homo sapiens
  misc_feature: 74415.UNK.UNK.UNK.pb.heavy.1.raw 74415
cgtatcgcctccctcgcgccatcagacagtatatacacgaccgtgctccgatttagctgcgtcacgatctctcttggggagctctgagagcggagccccagccccagaattccaggtgttttcatttggtgatcagcactgaacacagaggactcaccatggagttcgggctgagctgggttttccttgttgttatttacaaggtgtccagagtgaagtgcagttggtgagtccgggggagacttggtccagcccggagggtccctgagactctcctgtgtcgcctctggattcaccatcagtgaccaactatatggactgggtccgccaggctccagggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatccggtcttccccctggcgccctgctccaggagcacctccgagagcacagcggccctgggctgcctggtcaaggactacttcctatatactgtctgaggcggcctggcaaggcgcatag

SEQ ID NO: 793973 - DNA, 731 bp, Homo sapiens
  misc_feature: 74439.44.33.C11.1.pb.heavy.1.raw 74439
cgtatcgcctccctcgcgccatcagaccagtatatacacgaccggtgctcgatttagagtgagctcgttttggtttggggagctctgggagaggagcccagcaccagaagtcggcgggtgtttccagtcggtgatcagcaccgaacacagaggactcaccatggagtttggctgacctgggttttcctcgttgctcttttaagaggtgtcagtgtcaggtgaagctggtggagtctgggggagcgtggtccagcctgggaggtccctgagactctcctgtgtagcgtctggattcaccttcaacagacatggcatgcactgggtccgccaggctccaggcaagggactggagtgggtggcacttatatggtaatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctaactccaatggtatggacgcctggggccaagggaccacggtcgccgtctcctcagcctccacaagggcccatcggtcttcccctggcaccctcctccaagagcacctctgggggcacagcggccctggcctgcctggtcaaggactacttcctatatagctgtctgagcgggctggcaaggcgcatag

SEQ ID NO: 793974 - DNA, 727 bp, Homo sapiens
  misc_feature: 74441.44.86.H09.1.pb.heavy.1.raw 74441
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccatacattggagtagagcatgtcatatctgtatccacgagcccccatctctcgcacagtagtagacagccgtgtcctcggctctcaggctattcatttccagatatagtgtgtcttcgattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 793975 - DNA, 645 bp, Homo sapiens
  misc_feature: 74442.44.86.H09.1.pb.heavy.1.raw 74442
ctatgcgcctgccagcccgctcagacagtatataggaagtagtccttgaccaggcagcccagggccgctgtgcccccagaggtgctcctggagcagggcgccagggggaagacgatgggcccttggtggaagctgaggagacagtgaccagggtgccacggccccatagattgaaagaccagtctcgcctcgcacagaaaataaacggccgtgtccgcggcggtcacggaggtcagtttcaggagaagcggttcatggacgtgtccctcgaaatggtgagacgactcttgaggacggagagtagtacgtcgccccagtataatggatgtcaccaatccactccattccctccctggggctgccggatccagccccaagaatgatcagaactgatggaaactccagagacagtgcagatgagagacagggttcccgaaggcctcaccagtcctggcccgactcctgcagctgcacctggacaggacccatctgggagctgcaccagcaggaggaaaaaccacagtgcttcatgttcttgcacaggaggtccttgactctcagaaagcatccccaaaccaagtctatagcactaaatcgagcaccggtcgtgtatatactgtctgatggcgcgagggaggcgatacg

SEQ ID NO: 793976 - DNA, 633 bp, Homo sapiens
  misc_feature: 74451.44.86.H09.1.pb.heavy.1.raw 74451
cgtatcgcctcctcgcgccatcagacagtataacacgaccggtgctcgatttagtgctatagactgggtttggggatggctttctgagagtcaaggactcctgtgcaagaacatgaagcacctgtggtttttctcctgctgtggcagctcccagatgggtcctgtcccaggtgcagctgcagagtcgggcagactggtgaggccttcgggaaccctgtctctcatctgcactgtctctggagtttccatcagttctgatcattcttgggctggatccggcagccccagggagggaatggagtggattgtgacatccattatactggggcgacgtactactctccgtcctcagagtcgtctcaccatttcgagggacacgtccatgaaccgcttctccctgaaactgacctccgtgaccgccgcggacacggccgtttatttctgtgcgaggcgagactggtcttcatctatgggccgtggcaccctggtcactgtctcctcagcttccaccaagggcccatcggtcttccccctggcgcctgctcaggagcacctctgggggcacagcggccctgggctgcctggtcaggactacttctatatactgtctgagcgggctggcaaggcgcatag

SEQ ID NO: 793977 - DNA, 714 bp, Homo sapiens
  misc_feature: 74471.44.39.D06.1.pb.heavy.1.raw 74471
cgtatcgcctccctcgcgccatcagacagtatatacacgaccggtgctcgatttagtgacatctcgcagttctttggggagagacgagccagcactggaagtcgccggtgtttccattcggtgatcatcactgaacacagaggactcaccatggagtttggctgagctgggttttcctcgttgctctttaagaggtgtccagtgtcaggagcacttggtggagtctggggaggcgtggtccagcccgggaggtccctgagactctcctgtgtagcctctgggttctcattcgatagatttggttgcactgggtccgccaggctccaggcaaggggccgagtgggtggcagtcatctccgacgatggaagtgagaagtattactcagactccgtgaaggccgattcaccatctccagagacaattccaagaatatgctgtatttgcaaatgaacagcgtgagagttgacgacacgtctgtttattactgtgcgaggggacctccaaggaaacggttcggggaatcataaactactactatttgatggatgtctggggcaggggacgtcggtcaccgtctcctcagcttccaccaagggccatcggtcttcccctggcgccctgctccaggagcacctctgggcacagcggccctgggctgcctggtcaaggactacttcctatatactgtcctgagcgggctggcaggcgcatag

SEQ ID NO: 793978 - DNA, 608 bp, Homo sapiens
  misc_feature: 74489.UNK.UNK.UNK.pb.heavy.1.raw 74489
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgtagcattgtgcatgctagacgacaatatgaatctgcgggacccctagtggccaagatggccgctagcgggttccgcagcttttgacctggaccagggtgcatagcctgcccagccttc

SEQ ID NO: 793979 - DNA, 710 bp, Homo sapiens
  misc_feature: 74514.44.85.H08.1.pb.heavy.1.raw 74514
ctatgcgccttgccagcccgctcagacagtatataggaagtagtccttgaccaggcagcccagggcgctgtgcccccagaggtgctcttggaggagggtgccaggggaagaccgatgggcccttggtggaggctgaggagacggtgaccgtggtcccttggccccagacgtccataccgtagtagtagtccagcaggtgtagtactacaatatgtcctcgcacagtaatacacagccgtgtctcggctctccaggctgttcatttgcagatacagcgtgttcttggaattgtctctggagatggtgaatcggccttcacggagtctgcatagtattattacttccatcataccatataagtgccaccactccagccccttgcctggagcctggcggacccagtgcatgccataggtactgaaggtgaatcagacgctgcacaggagagtctcagggacctcccaggcctggaccacgcctccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctccttccccccccccgcgactgagtgatactaaatcgagcaccggtcgtgtatatactgtctgatggcgcgaggaggcgatacg

SEQ ID NO: 793980 - DNA, 735 bp, Homo sapiens
  misc_feature: 74515.44.33.C11.1.pb.heavy.1.raw 74515
cgtatcgcctccctcgcgccatcagacagtatatacacgaccggtgctcgatttagagtgagctcgttgggtttggggagctctgggagaggagcccagcaccagaagtcggcggtgtttccagtccggtgatcagcaccgaacacagaggactcaccatggagtttgggctgacctgggttttcctccgttgctcttttaagaggtgtccagtgtcaggtgaagctggtggagtctgggggaggcgtggtcccagcctgggaggtccctgagactctcctgtgtagcgtctggattcaccttcaacagacatggcatgcactgggtccgccaggctccaggcaagggactggagtgggtggcacttatatggtatgatggaagtaataaaatatttatgtagattccgtgaagggccgattccaccatctccagagacaattcgaagaacaccactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcgggctggcaagcgcatag

SEQ ID NO: 793981 - DNA, 677 bp, Homo sapiens
  misc_feature: 74523.44.6.A06.1.pb.heavy.1.raw 74523
cgtatcgcctccctcgcgccatcagaccagtatatacacgaccggtgctcgatttagatctactgacaaccacattcctcctctaaagaagcccctgggagcacagctcatcaccatggactggacctggaggtcctctttgtggtggcagcagcaacaggtgtccagtccctggtgcaactgtgcagtctgggactagaatgcccgcaaccttggtcctcggtgaccctttcctgcacggcctctggaagtactaccagttccactacttataccatcaactgggtgcgccagggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaaccctggtcattgtcacctcagcttccaccaagggcccatcggtcttcccccctggcgccctgctccaggagcacctctgggggcacagcgccctgggctgcctggtcaaggactacttcctatatactgtctgagcgggctggcaaggcgcatag

SEQ ID NO: 793982 - DNA, 664 bp, Homo sapiens
  misc_feature: 74530.44.86.H09.1.pb.heavy.1.raw 74530
cgtatcgcctccctcgcgccatcagacagtatatacacgaccggtgctcgatttagtgctatagacttgggtttgggggatgctttctgagagtcaaggacctcctgtgcaagaacatgaagcacctgtggttttttcctcctgctggtggcagctcccagatgggtcctgtcccaggtgccagctgcaggagtcggggcccaggactggtgaggccttcgggaaccctgtctctcatctgcactgtctctggagtttccatcagttctgatcattcttggggctggatccggcagccccccagggaggggaatggagtggattggtgacatccattatactgggggcgacgtacttactctccgtccctcaagagtcgtctcaccatttcgagggacacgtccatgaacgccgcttctccctgaactgacctccgtgaccgcgcggacacggccgtttatttctgtgcgaggccgagactggtctttcaatctatggggccgtggcacccctggtcactgtctcctcagcttccaccaagggcccatcggtcttcccccctggcgccctgctccaggagcacctctggggcacagcggccctgggctgcctggtcaaggactacttcctatatactgtctgagcgggctggcaaggcgcatag

SEQ ID NO: 793983 - DNA, 689 bp, Homo sapiens
  misc_feature: 74626.44.74.G08.1.pb.heavy.1.raw 74626
cgtatcgcctcctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactgtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccgggcagaattacgattaccgcggacaagtccacagacacagtctccatgacaatgagttctttgaaatccggacgacacggccgtctactactgtgcgagaggtccgtaccccagctcgcatggagccttttgagatctgggggcagggaccctggtcattgtcactcagcttccaccaagggcccatcggtcttccccctggcgccctgctcaggagcacctctgggcacagcggccctggctgcctgggtcaaggactaacttcctatatactgtctgagcgggctggcaaggcgcatag

SEQ ID NO: 793984 - DNA, 599 bp, Homo sapiens
  misc_feature: 74632.UNK.UNK.UNK.pb.heavy.1.raw 74632
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgatagactgacgggatcgctacagacatttaactcgctagtaacttaattgagatcctaggggatgggataggaaatagaatccaccctatcaccccccacatagcctgcttggggtgttgagtttacttttatttcgtgttggaatgagttgaacttcgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggcgctagcggttccgcagcttttgacctggaccagggtgcatagcctgcccagcct

SEQ ID NO: 793985 - DNA, 690 bp, Homo sapiens
  misc_feature: 74644.44.55.E11.1.pb.heavy.1.raw 74644
ctatgcgccttgccagcccgctcagacagtgtagtccttgaccaggcagcccaggccgctgtgccccagaggtgctcttggaggagggtgccaaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcacgaatggaaacacctcggaatcccagtgctgggctcctctccccaaacccaacgtgcgagtgctaaatcgagcaccggtcgtgtatatactgtctgatggcgcgaggaggcgatacg

SEQ ID NO: 793986 - DNA, 720 bp, Homo sapiens
  misc_feature: 74676.44.85.H08.1.pb.heavy.1.raw 74676
ctatgcgccttgccagcccgctcagacagtatataggaagtagtccttgaccaggcagcccaggccgctgtgcccccagaggtgctcttggaggagggtgccagggggaagaccgatgggcccttggtggaggctgaggagacggtgaccgtggtcccttggccccagacgtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactcagccccttgcctggagcctggcggacccagtgcatgccataggtactgaaggtgaatccagacgctgcaacaggagagtctcagggacctcccaggctggaccacgctcccccagactccaccagctgcacctgacactggacacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaatcgagcaccggtcgtgtatatactgtctgatggcgcgagggaggcgatacg

SEQ ID NO: 793987 - DNA, 606 bp, Homo sapiens
  misc_feature: 74680.44.36.D03.1.pb.heavy.1.raw 74680
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgcccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaggtgacctgggacaagacccaagagagatcgtgacgcagctaaatcgagcaccggtcgtgtatatactgtctgatggcgcgagggaggcgatacg

SEQ ID NO: 793988 - DNA, 701 bp, Homo sapiens
  misc_feature: 74685.44.55.E11.1.pb.heavy.1.raw 74685
ctatgcgccttgccagcccgctcagacagtatataggaagtagtccttgaccaggcagcccagggccgctgtgccccccagaggtgctcttggaggagggtgccagggggaagaccgatggggcccttggtggagcggaggcgacggtgaccagggttccctggccccagaagtcaaacgaataataaccactcgagcgccgacttggtctcgcacagtaatagacggccgtgtcgtcgcctctcaggttgttcattgaagattaaccgtgttcctggaattgtccctggagatgatgaatcggcccttcacggagtctgcgtagtatgtgaaatcaccagtataaatgactgagaccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcaggccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatgcgcgagggaggcgatacg

SEQ ID NO: 793989 - DNA, 695 bp, Homo sapiens
  misc_feature: 74700.44.71.G05.1.pb.heavy.1.raw 74700
ctatgcgccttgccagcccggcctcagacagtatataggaagtagtccttgaccaggcagcccagggccgctgtgcccccagaggtgctcctggagcagggcgcagggggagaccgatggggcccttggtggaagctgaagagacggtgaccattgtcccctggccccaaatatcaaatgcatcgacgtcccaggatcgcctggcgcagtaatagacgcctgtgtcgtcgggtctcaggtgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagacccgcctggctgtgccagcccccccccgactccgccagtcgcccctcgcactggacaccttctaaaaaactacaaggaaaatcaagattagcccaaactccatggtggtggtctgtgctcagtgctgatcaccaagtggaaactcctgggaatctcacggctgggggctcctctctcttgcgacgacactaaatcgagcaccggtcgtgtatatactgtctgattggcgcgagggaggcgatacg

SEQ ID NO: 793990 - DNA, 652 bp, Homo sapiens
  misc_feature: 74713.44.86.H09.1.pb.heavy.1.raw 74713
ctatgcgccttgccagcccgctcagacagtatataggaagtagtccttgaccaggcagcccagggccgctgtgcccccagaggtgctcctggagcagggcgccagggggaagacgatgggcccttggtggaagctggaggagaccagtgaccagggtgccacggcccatagattgaaagacagtctcgcctcgcacagaaataaacggccgtgtccgcggcggtcacggaggtcagttcaggggaagcggttcatggacgtgtccctcgaaatggtgagacgactcttgagggacggagagtagtacgtcgcccagtataatggatgtcaccaatccactccattcccctccctggggctgccggatccagcccccaagaatgatcagaactgatggaaactccagagaacaggtgcagatgagagacaggggttcccgaaggcctcaccagtcctggcccgactcctgcagctgcacctgggacaggacccatctgggagctgccaccagcaggaggaaaaaccacaggtgcttcatgttcttgcacaggaggtcttgactctcagaaagcatccccaaacccaagtctatagcactaaatcgagcaccggtcgtgtatatactgtctgatggcgcgagggaggcgatacg

SEQ ID NO: 793991 - DNA, 704 bp, Homo sapiens
  misc_feature: 74729.44.27.C05.1.pb.heavy.1.raw 74729
cgtatcgcctcctcgcgccatcagacagtatatacacgaccggtgctcgatttagacgcgatcgaagggtttgggcctgggaagacgagcccagcactggaagtccgggtttccactcggtgatcatcactgaacacagaggatccaccatggagtttgggctgagctgggttttccctcgttgccctcttaagaggtgtcatgttgtcaggtgcaattcggtggagtctggggaggcgtggccccagtaggggggtccctgagactctcctgtgcagcctctggattcaccttcgataattggatatgcagtgggtccgccaggctccaggccgaggggctggagtggtggcaggtgtgtcatttcatggagggaaatcaagtcctacggtgattccgttgaggggccgattcaccatctccagagacaattccgagaacacagtgtctcttcaaatgaacagcctgagacctcaggacacggccgtgtatttttgtgcgagctatctgtttccaaaatcggttcattcgacgcctggggccagggaaccctggtcaccgtctcctcggcctccaccagggcccatcggtcttccccctggcgccctgctccaggagcacctccgagagcaacagcggccctgggctgcctggtcaaggactacttcctatatactgtctgagcgggctggcaaggcgcatag

SEQ ID NO: 793992 - DNA, 713 bp, Homo sapiens
  misc_feature: 74765.UNK.UNK.UNK.pb.heavy.1.raw 74765
ctatgcgccttggccagcccgctcagacagtatataggaagtagtccttgaccaggcagcccagggccgctgtgccccccagaggtgctcttggaggaggcgtgccaggggaagaccgatgggcccttggtggaggcggaggcgacggtgaccagggttccctgggccccagaagtcaaacgaataataaccactccggagcgccgacttgtctcgcacagtaatagacggccgtgtcgtcgcctctcaggttgttcatttggaagataaaccgtgttcctggaatgttccctggagatggtgaatcggccttcacggagtctgcgtagtatgtgaaatcaccagtataaatgactgagacccactccagcccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaaacccaacgtgcgagtgcctaaatcgagcaccggtcgtgtatatactgtctgatggcgcggagggaggcgatacg

SEQ ID NO: 793993 - DNA, 560 bp, Homo sapiens
  misc_feature: 74799.44.78.H01.1.pb.heavy.1.raw 74799
cgtatcgcctccctcgcgccatcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggcagggaaccctggtcaccgtctcctcagcctccaccaagggcccatcggtcttccccctggcgccctgctccaggagcacctccgagagcacagcggccctggactgcctggtcaaggactacttcctatatactgtctgagcgggctgg

SEQ ID NO: 793994 - DNA, 702 bp, Homo sapiens
  misc_feature: 74800.44.55.E11.1.pb.heavy.1.raw 74800
ctatgcgcttgccagcccgctcagacagtatataggaagtagtccttgaccaggcagcccagggccgctgtgcccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttcctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgccgagggaggcgatacg

SEQ ID NO: 793995 - DNA, 737 bp, Homo sapiens
  misc_feature: 74803.UNK.UNK.UNK.pb.heavy.1.raw 74803
ctatgcgccttgccagcccgctcagacagtatataggaagtagtccttgaccaggcagcccagggccgctgtgccccagaggtgctccttggaggagggtgccaggggaagaccgatgggcccttggtggaggctgaggagacggtgacccgtggtcccttggccccagacgtccataccgtagtagtagtcccagcaggtgggtagtactacaatatgtcctcgcacagtaatacacagccgtgtccttccggctctcaggctgttcatttgcagatacagccgctgttctctgaattgtctctggagatggtgaatcggcccttcacggagtctgcatagtatttatccacttccatcataccatataagtgccacccactccagcccctgcctggagcctgggcggacccagtggcatgccatagtactgaaggtgaatccagacgctgcacaggagagtctcagggaccttcccaggctggaccacgcctcccccagactccaagctgcacctgacactggacacctcttaaaagagcaacgaggaaaaacccagctcagccccaaactccatggtgagtcctctgtgcttcagtgctgatcagccgaatggaaacaccggccgacttctagtgctgggctcctctcccagagctccccgcgactgagtgatactaaatcgagcacggtcgtggtatatacctgtctgatggcgcgcgagggagcgcgatacg

SEQ ID NO: 793996 - DNA, 707 bp, Homo sapiens
  misc_feature: 74812.UNK.UNK.UNK.pb.heavy.1.raw 74812
gtatcgcctccctcgcgccatcagaccagtatatacacgaccggtgctccgatttagctgcggtcacgatctctcttggggagctctgagagcggagccccagccccagaattcccaggtgttttcatttggtgatcagcactgaacacagaggactcaccatggagttcgggctgagctgggtttttcttgtgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagcttatcacagagtacgccgcgtctatgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcacccgttctcctcagcctccaccaagggccatcggtcttccccctgggcgccctgctccaggagcacctccgagagcacagcggccctgggctgcctggtcaaggactacttcctatatactgtctggagcgggctggcaaggcgcatag

SEQ ID NO: 793997 - DNA, 708 bp, Homo sapiens
  misc_feature: 74825.UNK.UNK.UNK.pb.heavy.1.raw 74825
cgtatcgcctccctcgcgccatcagacaagtatatacacgaccggtgctcgatttagccacacgatagttggtttggggatactttctgagactcatgggccttcctgcacaagaacatgaaaacacctgtggttcttccctcctcctggtggcacctcccagatgggtcgtgtccgaggtgcagctgccaggagttcgggcccagggacggtggaaagcctttcggagaccctgttccctcacctgcaatgttctctggtggttacatcagtagttattattggagttggctgcggcagtccgccggaagggactggagtggattgggcgcatctataacagtggcagcaccaactacaaccccgccctcaagagtcgagtccaccatgtcactagacaggtccaagaaaccagttctccctgaaattgactttctgtgaccgccgcggacacggccgtatattattgtgcgagagatttcctatcgataacagtagagacgggggggcgaaactggctcgaccccctggggccagggaaccctggtcaccgtctccctcagcctccaccaagggcccatcggtctttccccctggccaccccctcctccaaggagcacctctgggggcaacagcggccctgggctgcctggtccaaggaactacttcctatatactgtctgagcgggcctggcaagggcgcataga

SEQ ID NO: 793998 - DNA, 728 bp, Homo sapiens
  misc_feature: 74842.44.33.C11.1.pb.heavy.1.raw 74842
ctatgcgccttgccagcccgctcagacagtatataggaagtagtccttgaccaggcagccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataaatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaagagcaacgaggaaaacccaggtcagcccaaactccatggtgagtcctctgtgttcggtgctgatcaccgactggaaacaccgccgacttctggtgctgggctcctctccagagctccccaaaacccaacgagctcactctaaatcgagcaccggtcgtgtatatactgtctgatggcgcgagggaggcgatacg

SEQ ID NO: 793999 - DNA, 719 bp, Homo sapiens
  misc_feature: 74843.44.55.E11.1.pb.heavy.1.raw 74843
ctatgcgccctgccagcccgcctcagacagtatataggaaagtagtccttgaccaggcagcccccaggggccgctgtgcccccagaggtgctcttgggaggaggggtgccagggggaagacgatgggcccttggtcggaggcggaggcgacggtgaccaggggttccctggccccagaagtcaaacgaataatacccactccgacgccgactttgtctcgcacagtaatagacggccgtgtcgtcgcctctcaggttgttccatttgaagataaaccgtgttccctggaatttgtccctggagatggtgaatcggccctctcacggagtctgcgcgtagtatgtgaatcaccagtataaatgactgagacccactccagccccttccctggagcctggcggacccaaactcatgtagttgctgctgacggtgagcccagggctgcacaagagagtctctgggacccccccaggctggactaagcctcctccagactccatcagccgcacctcacactggacaccttttaaaagtccacacaggagaacccagctcagccaaaaactccatggtgagtctctgtgttcagtgctgatcaccgaatggaaacacctcggaatcccagtgctgggctcctctccccaaacccaacgtgcgagtgctaatcgagcaccggtcgtgtatatactggtgctgatggcgcgagggagggcgatacg

SEQ ID NO: 794000 - DNA, 683 bp, Homo sapiens
  misc_feature: 74852.UNK.UNK.UNK.pb.heavy.1.raw 74852
tatgcgccttgccagccgctcagacagtatataggaagtagtccttgaccaggcagcccagggccgctgtgctctcggagtgctcctggagcagggcgcccaggggaagaccgatggcccttggtggaggctgaggagacggtgaccagggttccctgggcccagtagtcaagcgggaccgtctcgggagggggctctcgcacaataatagacagccgtgtcctcacttgtgaggttgtacatttgagatgcagtgtgttccctgaattgtctctggagacggtgaatcggcccttctcggagtctccgtagtgttcttcaattccatcttctgatataattgcacccactccagccccttgcctggagcctggtggacccagtgcatggcataggtcctgaagatgaatcagaggctgcacaggagagtctcaggagttcccaggctggccgctcctccccagactccactagctgcacctgacactggccacctcttaaagagcaacgaggaaaacccatctcagcccaaagtccatggtgaggtcctctgtgttcagtgatgatcaccgaatggaaacaccggcgacttccagtgctggctcgtctcccccccctgaagcgtagagctaaatcgagcacgtccgtgtatatactgtctgatggcgcgaggaggcgatacg

SEQ ID NO: 794001 - DNA, 700 bp, Homo sapiens
  misc_feature: 74867.UNK.UNK.UNK.pb.heavy.1.raw 74867
ctatgcgccttgccagcccgctcagaagtatataggaagtagtccttgaccaggcagcccagggccgctgtgctctcggaggtgctcctggagcagggcgccaggggaagaccgatgggcccttggtggaggctgaggagacggtgaccagggtccctggccccagtcatgcgcccggtaataactactaccacctcccgatctcgcacagtaatacagagccgagtcctcgactctcaggctgaccatttccaagtacacaatgttccgggaattgtctctgagatggtgaatcggcccttcacggagtctgcataatattcagaacttccatcatgtgctataactgccaaccactcggccccttgcctggagcctggcggacccagtgcatgccagaaccactgaaactaaatccagaggcttcacaggagagtctcagggacctcccaggctggaccacgcctccccagactccaccaggtgcacctgacagtggacacctcttaaaagagcaacgaggaaaacccagctcagcccaaactccatggtgagtcctctgtgttcagtgctgatcaccgaatggaaacaccgccgacttctagtgctgggctcctctccagacccctttcccttcacactacactaaatcgagcacggtcgtgtatatactgtctgatggcgcgagggaggcgatacg

SEQ ID NO: 794002 - DNA, 554 bp, Homo sapiens
  misc_feature: 74913.44.43.D10.1.pb.heavy.1.raw 74913
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatattcaactgggtgcgacaggccactggacaagggcttgagtggatgggatggatgaaccctaacagtggtaacacaggctatgcacagaagttccagggcagagtcaccatgaccaggaacacctccataaaacacagcctacatggagctgagcagcctgagatctgaggacacggcccgtgtattactgtgcgagatcccgaaagtatagcagctcgtcggggaggtggttcgacccctggggccagggaaccctggtcaccgtctcctcagcttccaccaagggcccatcggtcttcccctggcgccctgctccaggagcacctctgggggcacagcggccctgggctgcctggtcaaggactacttcctatataactgtctgagcggcctggcaaggcgcgatag

SEQ ID NO: 794003 - DNA, 723 bp, Homo sapiens
  misc_feature: 74917.44.55.E11.1.pb.heavy.1.raw 74917
cgtatcgcctccctcgcgccatcagacagtatatacacgaccggtgctcgatttagcactcgcacggttgggtttggggagaggagcccagcactgggattccgaggtgtttccattcggtgatcagccactgaacacagaggactcaccatggagttttggctgagctgggtttctccttgttggacttttttaaaaggtgtccagtgttgaggtgcggctgatggagtctggaggaggcttagtccagcctggggggtcccagagactctcctgtgcagcctctgggctcaccgttcagcagcaactacatgagtttgggtccgccaggctccagggaaggggctggagtgggtctcagtcattttatactggggatttcacatactaacgcagactccgtgaagggccgatttcaccatctccagggacaattccaggaacacggtttatcttcaaatgaacaaacctgagagggcgacgacacggccgtctattactgtgcgagacaagtcggcgctcgggagtggttattattcggtttgacttctggggccagggaaccctggtcaccgtcgcctcgcctccaccaagggccccatcggtcttcccccctggcaccctcctccaaggagcacctctgggggcacagcggccctgggctgcctggtccaaggactacttcctatatactgtctggagcgggcctggcaaggcgcatag

SEQ ID NO: 794004 - DNA, 704 bp, Homo sapiens
  misc_feature: 74923.44.73.G07.1.pb.heavy.1.raw 74923
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctcccctgagcgtagagctaaatcgagcaccggtcgtgtatatactgtctgatggcgcgagggaggcgatacg

SEQ ID NO: 794005 - DNA, 796 bp, Homo sapiens
  misc_feature: 74931.UNK.UNK.UNK.pb.heavy.1.raw 74931
tcgtatcgcctccctcgcgccatagacagtatatacacgaccggtgctcgatttagtcctcagcatgtgaatgggggttggtcctggagaggagccacagcactgggatgtccggcgtgttttccattacggtgaagtcagggtctgggagagcactgcagcacaatcgagggtactcattccatgatcgcttggctggactgaaggccatgtggcagtctaatggttttcctcgtggctcttttaagaggtgtccactgtcagaggtgcaggcctgagtggagtctggagaggcgtggtcagcagcctgctggaggtccctcctgagagactctcctgtgcagcctctgggctcagttcagcagcaaactgcatgagttgggtcgaccaggctccaggcaagggctggagtggtctcagtcattatactgtgattctgcgatcacgaatacccgccgatatggatgctaggctcatctaccgtgatcagaggacgccggaatttcgtcagaggcatgtcgtccactgcaggacaattccggaaatatgtgtatcttaaatgaacaggcctggagaggcgagcgacctggcagcgtctgctattactgtgcgagatcgggaggtggtggtagtagtgttattacccgttatgactggggccaggggaccctggtcaccgtctcctcagcctccacccaagggccatcggtcttccccctggcgccctcgctccaagagcacctcgagagcacagcggccctgggctgcctggtcaaggactactacttcccatata

SEQ ID NO: 794006 - DNA, 719 bp, Homo sapiens
  misc_feature: 74941.UNK.UNK.UNK.pb.heavy.1.raw 74941
cgtatcgcctccctcgcgccatcagacagtatatacacgaccgccggtgctcgatttagcactcgcacgttgggtttgggggggagaggagcccagcactgggattccgaggtgtttccattccggtgatcagcactgaacacagaggactcaccatggagttttggctgagctgggttctccttgttggacttttaaaaggtgtccagtgtgaggtgcggctgatgggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgattccacatactacgcagactccgtgaagggccgattcaccatctccagggacaattccaggaacacggtttatcttcaaatgaacaacctgagaggcgacgacacggccgtctattactgttgcgagacaagttcggcgctcggagtggttattattcgtttgacttctggggcccagggaaaacccctggtcaccgtcgcctcccgcctccaccaagggcccatcggtcttcccccctggcaccctcctccaagagcacctctgggggcacagcggccctggctgcctggtcaaggactacttcctatatactgtctgaagcgggctggcaaggcggcatag

SEQ ID NO: 794007 - DNA, 702 bp, Homo sapiens
  misc_feature: 74945.44.55.E11.1.pb.heavy.1.raw 74945
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794008 - DNA, 698 bp, Homo sapiens
  misc_feature: 74958.44.36.D03.1.pb.heavy.1.raw 74958
ctatgcgccttgccagccgctcagacagtatataggaagtagtccttgaccaggcagcccagggcgctgtgctctcggagggtgctcctggagcagggcgccagggggaagaccgatgggcccttggtggaggctgaggagacggtgaccagggttcctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcgccaagccactccaggccccttccctggagcctggcggaccagtccaatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgccgagggaggcgatacg

SEQ ID NO: 794009 - DNA, 694 bp, Homo sapiens
  misc_feature: 74966.44.55.E11.1.pb.heavy.1.raw 74966
cgtatcgcctccctcgcgccatcgacagtatatacacgaccggtgctcgatttagcactcgcacgttggtttgggggggagagagcccagcactgggatccgaggtgtttccattcggtgatcagcactgacacagaggactcaccatggagttttgctgagctgggttctccttgttggacttttaaaggtgtccagtgtgaggtgcggctgatggagtctggaggaggcttagtccagcctggggggtccccagagactctcctgtgcagctctgggctcaccgtcagcagcaactacatgagttgggtcgccaggctccaggaaggggctgagtgggttctcagtcatttatactggtgatttcacatactacgcagactccgtgaaggggccgattcaccatctccagggacaattccaggaacacggtttatcttcaaatgaacaacctgagaggcgacgacacgccgtctattactgtgcgagacaagtcggcgctcggagtggttattattcgttgacttctgggccagggaaccctggtcaccgtcgcctccgcctccaccaagggcccatcggtcttccccctggcaccctcctccaagagcacctctgggggcacagcggccctgggctgctggtcaaggactacttcctatatactgtctgagcgggctggcaaggcgcatag

SEQ ID NO: 794010 - DNA, 726 bp, Homo sapiens
  misc_feature: 74983.UNK.UNK.UNK.pb.heavy.1.raw 74983
ctatgcgccttgccagcccgctcagacagtatataggaagtagtccttgaccaggcagcccagggccgctgtgcccccagaggtgctcttggaggaggtgccagggggaagaccgatgggcccttggtggaggcggaggcgacggtgaccagggtttccctggccccagaagtcaaacgaaataataaccactccgagcgccgacttgtctcgccacagtaatagacggccggtcgtcgcctctcaggttgttcatttgaagataaaccgccgtgttcctggaattgtccctggagatggtgaatcggcccttcacggagtctggcgtagtatgtgaaatcaccagtataaatgactgagacccactccagccccttccctggagcctggcggaccccaactcatgtagttggctgctgacggtgagcccagagggcctgcacaggagagtctctgggaaccccccaggctggactaagcctctcagactccatcagcccgcacctcacacctggacaccttttaaaagtccaacaaggagaacccagctcagcccaaaactccatggtgagtcctcctgtgtttcagtgctgatcaccgaatggaaacacctcggaattcccagtgctgggctcctctccccccccccaaacccaacgtgcgagtgctaaatcgagcaccgggtcgtgtatatactgtctgatggcgcgagggagggcggatacg

SEQ ID NO: 794011 - DNA, 688 bp, Homo sapiens
  misc_feature: 74985.44.55.E11.1.pb.heavy.1.raw 74985
cgtatcgcctccctcgcgccatcagacagtatatacacgaccggtgctcgatttagcactcgcacgttgggtttgggggaagaggccagcactgggattccgaggtgtttccattcggtgatcagcactgaacacagaggactcaccatggagttttggctgagctgggttctccttgttggactttaaaaggtgtccagtgtgaggtgcggctgatggagtctggaggaggcttagtcagcctggggggtcccagagactctcctgtgcagcctctgggctcaccgtcagcagcaactacatgagttgggtccgccaggctccagggaagggctggagtgggtctcagtcatttatactggtgatttcacatactacgcagactccgtgaagggccgattcaccatctccagggacattcaggaacacggttatcttcaaatgaacacctgagaggcgacgacacggccgtctattactgtgcgagacaagtcggcgctcggagtggttattattcgtttgacttctggggcagggaaccctggtcaccgtcgcctccgcctccaccaagggcccatcggtcttcccctggcaccctcctccaagagcacctctggggcacagcggccctggctgcctggtcaaggactacttcctatatactgtgagcgggctggcaggcgcatag

SEQ ID NO: 794012 - DNA, 660 bp, Homo sapiens
  misc_feature: 74988.UNK.UNK.UNK.pb.heavy.1.raw 74988
ctatgcgccttgccagccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttgccccagacgtccatacgtagtagtagtatgcaactcccgaactccgcaccggctcttgcacagtaatacacagccgtgtcctcggctctcagactgttcatttgcagatacagcgtgttcttggcgttgtctctggagatggtgatcggcccttcacggagtccgcgtagcttgtgctactcccatcactataatacgtgagacccacaccagccccttccctggagcttggcggacccagtgcatccagtagctactgaaggtgaatcagaggctgcacagggagagtctcagggacccccaggctgaactaagcctcccccatgcccacggtgccagagcccaaatcttgtgacacacctcccccgtgcccaaggtgcccagcacctgaactcctgggaggaccgtcagtctcctcttcccccaaacccaactatcagatactaaatcagagcaccgtcgtgtatatactgtctgatggcgcgagggaggcgatacg

SEQ ID NO: 794013 - DNA, 732 bp, Homo sapiens
  misc_feature: 75032.UNK.UNK.UNK.pb.heavy.1.raw 75032
ctatgcgccttgccagcccgctcagacagtatataggagagtagtccttgaccaggcagcccaggccgctgtgctctcgggaggtgctcctggagcaggcgccaggggggaagaccgatggcccttggtggaaggcgccgaggagacggtgacccagggttccctggccccaggcgtcgaatgaaaccgatttttggaaacagatagttctcgcacaaaaatacacggccgtgtcctgaggtctcaggctgttcatttgaagagacactgtgttctcggaattgtctctggagatggtgaatcggccctcaacggaatcaccgtagacttgatttcctcccatgaaatgaaccaacacctgccacccactccagcccctcgcctggaggctggcgcggaccccaactgcatattccaattatcgaaaggtgaatccagaggctgcacaggagagtctcagacgagacccccctactgggcggccgcccgcctccccagactccagaattgcacctgacacatgacacctcttaagagggcaacgaggaaaaccagctcagcccaaactccatggtgagtcctctggttcagtgatgatcaccgaagtgaaacaccgggcgacttccagtgctgggctcgtctccagggcgtcccccaaacccttcgatcgccggtctaaatcagcaccggtcgtgtatatactgtctgatggccgggcgagagggcgatacg

SEQ ID NO: 794014 - DNA, 715 bp, Homo sapiens
  misc_feature: 75046.44.85.H08.1.pb.heavy.1.raw 75046
cgtatcgcctccctcgcgccatcagacagtatatacacgaccggtgctcgatttagtatcactcagtcgcgggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaaggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctgggccaagggaccacggtcaccgtctcctcagcctccaccaagggcccatcggtcttccccctggcaccctcctccaagagcacctctgggggcacagcggccctggctgcctggtcaaggactacttcctatatactgtctgagcggctggcaaggcgca

SEQ ID NO: 794015 - DNA, 610 bp, Homo sapiens
  misc_feature: 75051.UNK.UNK.UNK.pb.heavy.1.raw 75051
ctatgcgccttgccagcccgctcagacagtatataggaagtagtccttgaccaggcagcccagggccgctgtgccccagaggtgctcctggagcagggcgccagggggaagacgatggcccttggtggaagctgaggagacggtgaccgtggtccttggccccagacgtccataccgtagtagtagtatgcaactcccgaactccgcaccggctcttgcacagtaatacacagccgtgtcctcggctctcagactgttcatttgcagatacagcgtgttcttggcgttgtctctggagatggtgaatcgccccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccggactccaccagctgcacctcacactggacaccttttaaaatagcaacaaggaaaacccagctatcagatactaaatcgagcaccgtcgtgtatatactgtctgatggcgcgagggaggcgatacg

SEQ ID NO: 794016 - DNA, 669 bp, Homo sapiens
  misc_feature: 75053.UNK.UNK.UNK.pb.heavy.1.raw 75053
cgtatcgcctccctcgcgccatcagacagtatatacacgacggtgctcgatttagagagagtgtgttgagctctgggagaggagcccagccttggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctgggagtcccttagactctcctgtgcagcctctggattcactttcagtaacgcctggatgacctggtccgccaggctccagggaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttcccctggcgccctgctccaggagcacctccgagagcacagcggcctggctgcctggtcaagactactcctatatactgtctgagcgctggcaaggcgcatag

SEQ ID NO: 794017 - DNA, 710 bp, Homo sapiens
  misc_feature: 75056.44.56.F01.1.pb.heavy.1.raw 75056
cgtatcgcctccctcgcgcatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccagggacaatggtcaccgtctcttcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794018 - DNA, 703 bp, Homo sapiens
  misc_feature: 75087.44.36.D03.1.pb.heavy.1.raw 75087
cgtatcgcctccctcgcgccatcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794019 - DNA, 648 bp, Homo sapiens
  misc_feature: 75101.44.23.C01.1.pb.heavy.1.raw 75101
ctatgcgccttgcagcccgctcagacagtatataggaagtagtccttgaccaggcagccccagggccgctgtgcccccagaggtgctcctggagcagggcgccaggggaagaccgatgggccttggtggaagctgaggagacagtgaccagggtgccacggccccatagattgaaagaccagtctcgcctcgcacagaaataaaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctggggctgcggatccagccccaagaatgatcagaactgatggaaactccagagacagtgcagatgagagacagggttcccgaaggcctcaccagtcctgggccgactcctgcagctgcacctgggacaggacccatctgggagctgccaccagcaggaggaaaaaccacaggtgcttcatgttcttgcacaggaggtccttgactctcagaaagcccccaatcccctaatcacgtgtactaaatcgagcaccggtcgtgtatatactgtctgatggcgcgaggaggcgatacg

SEQ ID NO: 794020 - DNA, 682 bp, Homo sapiens
  misc_feature: 75105.UNK.UNK.UNK.pb.heavy.1.raw 75105
cgtatcgcctccctccccgcgccatcagacagtattataccacggaccggtgctcggatttagtagtagattccgcggggggctttctgagagtcatggacctcctgtgcaagaacatgaagcacctgttggttcttcctcctgctggtggcgcgctcccagatggttcctgtcccagctgcagctgcaggagtcgggcccaggactggtgaagccttcgcggagaccctgtcctcacctgcactgtctctggtggctccatcagccagtagtagttactactgggggctggatccgccagcccccagggaaggggctggaggattgggagtattctattatagtgggaggcactactagcaaccgtccctcaagagtcgagtcaccatatcagtagaagcacgtccaagaaccagttctccctgaagctgagcctctgtgaccgccgcggacacggccgtgtattactgtgcgagagtagggccagttcgtcaccaactactttgaccactggggccagggaaccctgggtcaccgtctcctcagctcccacaagggcccatcggtcttccccctggcaccctcctccaagagcacctctgggggggcacagcggcccctgggctgcctggtcaaggactacttcctatatactgtctgagcgggctggcaaggcgcatag

SEQ ID NO: 794021 - DNA, 708 bp, Homo sapiens
  misc_feature: 75106.UNK.UNK.UNK.pb.heavy.1.raw 75106
ctatgcgccttgccagccccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcgcgcgtactctgtgataaagctggcaactttgttttttactgcggccaagccactccagccccttcctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcggagcaccggtcgtgtatatactgtctgatggcgcgagggaggcgatacg

SEQ ID NO: 794022 - DNA, 705 bp, Homo sapiens
  misc_feature: 75110.44.36.D03.1.pb.heavy.1.raw 75110
cgtatcgcctccctcgcgccatcagacagtatatacacgaccggtgctcgatttagctgcgtcacgatctctcttggggagcgagagcggagccccagccccagaattcccaggtgttttcatttggtgatcagcactgaacacagaggaactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgcccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggccccatcgtcttccccctggcgccctgctccaggagcacctccgagagcacagcggccctgggctgcctggtcaaggaactacttcctatatactgtctgagcgggctggcaaggcgcatag

SEQ ID NO: 794023 - DNA, 678 bp, Homo sapiens
  misc_feature: 75114.UNK.UNK.UNK.pb.heavy.1.raw 75114
ctatgcgccttgccagccgctcagacagtatataggaagtagtccttgaccaggcagcccagggccgctgtgcccccagaggtgcctctggaggagggtgccagggggaagaccgatgggcccttggtgaggctgaggagacggtgacccagggttccctggccccagtggtcaagagttggtgacgaactgccctagcctctcgcacagtaatacaccggccgtgtccgcggcggtcacagagctcagcttcagggagaactggttcttggacgtgtctatctgattatggtcgactcgactcttgagggacgggttgtagtaggtgctcccactaatctaagatactcccatccactccagcccctccctgggggctggcggatccagcgccccagtagtaactactactgctggatggacgccaccagagacagctgcaggtgagggacagggctccgacaggcttcacccagtcctgggcccgactcctgcagctgcagctgggacacaggacccatctgggagccgccaccagcaggaggaagaaccacaggtgcttcatgttcttgccacaggaaggtccatgactctcagtaagccgcgccgcggaatctacactactactcgagcaccggtcgtgtatatactgtctgatggcgcgagggaggcgatacg

SEQ ID NO: 794024 - DNA, 726 bp, Homo sapiens
  misc_feature: 75121.44.85.H08.1.pb.heavy.1.raw 75121
cgtatcgccctccctcgcgccatcagacagtatataccacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtcccagtgtcaggtgcagctggtggagtctgggggaggcgtggtccagcctgggaggtccctgagactctcctgtgcagcgtctggattcaccttcagtacctatggcatgcactggtccgccaggctccaggcaaggggctggagtgggtggcacttatatggtatgatggaagtaataaatactatgcgacttccgtgaagggccgattcaccatctccagagacaattccaagaacacgctgtaatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaaggcccatcggtcttccccctggcaccctcctccaagagcacctctgggggcacagcggccctgggctgcctggtcaaggactacttcctatataactgtctgagcgggctggcaaggcgcatag

SEQ ID NO: 794025 - DNA, 688 bp, Homo sapiens
  misc_feature: 75127.44.27.C05.1.pb.heavy.1.raw 75127
cgtatcgcctccctcgcgccatcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggggtccgccaggctccaggcgagggctggagtgggtggcaggtgtgtcatttcatggaggaaatcaagtctacggtgattccgttgagggccgatcaccatctccagagacaattccgagaacacagtgtctcttcaaatgaacagcctgagcctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctattatactgtctgagcgggctggcaaggcgcatag

SEQ ID NO: 794026 - DNA, 684 bp, Homo sapiens
  misc_feature: 75143.44.45.E01.1.pb.heavy.1.raw 75143
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctctttaagaggtgtccagtgtcaggttcagctggtggagtctgggggaggcgtggtccagcctgggacgtccctgagactctcctgtgttgcggtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagccccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgtatag

SEQ ID NO: 794027 - DNA, 611 bp, Homo sapiens
  misc_feature: 75154.UNK.UNK.UNK.pb.heavy.1.raw 75154
gaaggctgggcaggctatgcaccctgggtccaggtcaaaagctgcggaacccgctagcggccatcttggccactaggggtcccgcagattcatattgtcgtctagcatgcacaatgctgcaaaccccagcttgcaatgcccacagcaagcggccaatctttacgccacgttgaattgtttattacctgtgactggctatggctttgcaacgccactcgtaaaactagtactttgcggttaggggaagtagacaaacccattactccacttcccggaagttcaactcattccaacacgaaataaagtaaactcaacaccccaagcaggctatgtgggggggtgatagggtggattctattttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggttcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794028 - DNA, 608 bp, Homo sapiens
  misc_feature: 75172.UNK.UNK.UNK.pb.heavy.1.raw 75172
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgttgggggggtgataggggtggattctatttcctatcccatccctaggatctcaattaagttactagcgagttaaatgtctgtagcgatcccgtcagtcctatcgcgcgcatcaagacctggttgttgagcgtgcagtaagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794029 - DNA, 655 bp, Homo sapiens
  misc_feature: 75176.44.86.H09.1.pb.heavy.1.raw 75176
cttgcgccttgccagcccgctcagacagtatataggaagtagtccttgaccaggcagccagggccgctgtgcccccagaggtgctcctggagcagggcgccagggggaagaccgatgggggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggagggtccttgactctcagaaagcatccccaaacccaagtctatagcactaaatcgagcaccggtcgtgtatatactgtctgatggcgcgagggaggcgatacg

SEQ ID NO: 794030 - DNA, 691 bp, Homo sapiens
  misc_feature: 75182.UNK.UNK.UNK.pb.heavy.1.raw 75182
cgtatcgcctccctcgcgccatcagacagtatatacacgaccgggtgctcgatttagctgcgtcacgatctctcttgggggagagcggagcccccagccccagaattcccaggtgttttcatttggtgatcagcactgaacacagaggactcgcaccatggagttcgggctgagctgggttttccttgttgttattttacaaggtgtccagagtgaagtgcagttggtggagtccggggagacttggtccagcctggaggggtccctgagactctcctgtgtccgcctctggatgtcaccatcagtgaccactatatggactggggtccgccaggctccagggaaggggctggagtgggcttgccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccggtctcctcagcctccaccaaggggcccatcggtcttccccctggccgccctgctccaggagcacctcgagagcacagcggccctggctgcctggtcaaggactacttcctatatactgtctgagcggg

SEQ ID NO: 794031 - DNA, 665 bp, Homo sapiens; identical to SEQ ID NO: 791013
  misc_feature: 75187.44.12.B01.1.pb.heavy.1.raw 75187

SEQ ID NO: 794032 - DNA, 549 bp, Homo sapiens
  misc_feature: 75191.44.43.D10.1.pb.heavy.1.raw 75191
ctatgcgccttgccagcccgctcagacagtatataggaagtagtccttgaccaggcagcccagggccgctgtgcccccagaggtgctcctggagcagggcgccagggggaagaccgatgggccttggtggagctgaggagacggtgaccagggttccctggccccaggggtcgaaccacctcccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgccacccagttgatatcataattggtgaaggtgtatccagaagccttgcaggagaccttcactgaggccccaggcttcttcacctcagcccccttactgctagtctaaatcgagcaccggtcgtgtatatactgtctgatggcgcgagggaggcgatacg

SEQ ID NO: 794033 - DNA, 693 bp, Homo sapiens
  misc_feature: 75214.44.73.G07.1.pb.heavy.1.raw 75214
cgtatcgcctccctcgcgccatcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaagggctggagtgggtggcaattatatcagaagatggaattgaagaacactacggagactccgagaaggggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794034 - DNA, 658 bp, Homo sapiens
  misc_feature: 75242.UNK.UNK.UNK.pb.heavy.1.raw 75242
cgtatcgggctccctcgcgccatcagacagtatatacacgaccgtgctcgatttagtgctatagacttggggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcggaaccctgtctctcatctgcactgtctctggagtttccatcagtttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccggccgcggacacggcccgtttatttctgtgcgaggcgagactggtctttcatctatggggccgtggccaccctggtcactgtctcctcagcttccaccaagggcccatcggtcttcccctgggcgccctgctccaggagcacctctggggcacaggccggccctggggctgcctggtcaaggactacttcctatatactgtctgagcgggctggcaaggcgcatag

SEQ ID NO: 794035 - DNA, 644 bp, Homo sapiens
  misc_feature: 75246.44.19.B08.1.pb.heavy.1.raw 75246
cgtatcgcctcctcgcgccatcagacagtatatacacgaccggtgctcgatttagtgagtcagtaagggggactcctgtgccccaccatggacacactttgctccacgctcctgctgctgaccatcccttcatggggcctgtccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794036 - DNA, 666 bp, Homo sapiens
  misc_feature: 75257.44.6.A06.1.pb.heavy.1.raw 75257
cgtatcgcctccctcgcgccatcagacagtatatacacgaccggtgctcgatttagatctactgacaaccacattcctcctctaaagaagccctgggagcacagctcatcaccatggactggacctggaggttcctctttgtggtggcagcagcaacaggtgtccagtcctggtgcaactggtgcagtctgggactagaatgccgcaaccttggtcctcggtgaccctttcctgcacggctctggaagtactaccagttccactacttataccatcactgggtgcgccaggcccctggacaagggcttgagtggatgggtggaatcatcctcttttttggctcactcacctacgcacgagacttccggggcagaattacgattacgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcactcagcttccaccaagggcccatcggtcttccctggcgccctgctccaggagcacctctggggcacagcggccctgggctgcctggtcaaggactacttcctatatactgtctgagcgggctggcaaggcgcatag

SEQ ID NO: 794037 - DNA, 605 bp, Homo sapiens
  misc_feature: 75266.UNK.UNK.UNK.pb.heavy.1.raw 75266
gaaggctgggcaggctatgcagccctggtccaggtcaaaagctgcggaacccgctagcggccatcttggccactaggggtcccgcagattcatattgtcgtctagcatgcacaatgctgcaaaccagctttgcaatgcccacagcaagcggccaatctttacgccacgttgaattgtttattacctgtgactggctatggcttgcaacgccactcgtaaaactagtactttgcggttaggggaagtagacaaacccattactccacttccggaagttcaactcattccaacacgaaataaaagtaaactcaacacccaagcaggctatgtggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttagtcatcccagaccgcatctggcgcctaaacgttcagtggtagctaaggcgtcaccttcgactgtctaaaggcaatatgtcggtccttagctccaagtccctagcaagcgtgtcggg

SEQ ID NO: 794038 - DNA, 627 bp, Homo sapiens
  misc_feature: 75282.UNK.UNK.UNK.pb.heavy.1.raw 75282
ctgcgccttgccagcccgctcagaccagtatatagggaaagtagtccttggaccaggcagcccagggcccgctgtgcccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggtttcaatggacgtgtccctcgaaatggtgagacgactcttgagggacggagagtagtacgtcgccccagtataatggatgtcaccaatccactccattcccctccctgggggctgccgatccagccccaagaatgatcagaactgatggaaactccagagacagtgcagatgagagacagggtttcccgaaggcctcaccagtcctgggccccgactcctgcagctgcacctgggacaggacccatctgggagctgccaccagccaggaggaaaaaccacaggtgttcaccctgccccaatccctaatcacgtgtactaaatcgagcaccgtcgtgtatatactgtctgatggcgccgagggaggcgatacg

SEQ ID NO: 794039 - DNA, 495 bp, Homo sapiens
  misc_feature: 75286.UNK.UNK.UNK.pb.heavy.1.raw 75286
cgtatccctcctcgcgcatcagacagtataacaacccgtgctcgatttagtatctgatagttgggttggggggtcctgagactctcctgtgcagcctctggattcaccttcagtagctactggatgcactgggtccgccagctccaggaaggggctgggtgggtctcacgtataatagtgagggagtagccaagacgcgactccgtgaagggccgatcaccatctcagagacaaacgcaagacacgctgtactgcaaatgaacagtctgaggccgaggacacggcgtgtattactgtgcaagagccgtgcgggagtcggggattgcatactactactacggtatggacgtctgggccaaggaccacggtcaccgtctcctcagcttccaccaagggcccatcggtctccccctggccctgctccaggagcacctctgggggcacagcggcctggctgcctgtcaggactacttcctataactgtctgagcgggct

SEQ ID NO: 794040 - DNA, 700 bp, Homo sapiens
  misc_feature: 75311.44.55.E11.1.pb.heavy.1.raw 75311
ctatgcgccttgccagcccgctcagacagtatataggaagtagtccttgaccaggcagcccagggccgctgtgcccccagaggtgctcttggaggagggtgccaggggaagaccgatgggccctttggtggaggcggaggcgacggtgaccagggttcctggccccagaagtcaaacgaataataaccactccgagcgccgacttgtccgcacagtatagacggccgtgtcgtcgcctctcaggttgttcatttgaagataaaccgtgttcctggaattgtcctggagatggtgaatcggccttcacggagtctgcgtagtatgtgaaatcaccagtataaatgactgagacccactccagccccttcctggagcctggcggacccaactcatgtagttgctgctgacggtgagcccagaggctgcacaggagagtctctgggaccccccaggctggactaagcctcccagactccatcagccgcacctcacactggacaccttttaaaagtccaacaaggagaacccagctcagccaaaaactccatggtgagtcctctgtgttcagtgctgatcaccgaatggaaaacacctcggaatcccagtgctgggctcctctcccccccaaacccaacgtgcgagtgctaaatcgagcaccggtcgtgtatatactgtctgatggcgcgagggaggcgatacg

SEQ ID NO: 794041 - DNA, 577 bp, Homo sapiens
  misc_feature: 75317.UNK.UNK.UNK.pb.heavy.1.raw 75317
cgtatcgcctccctcgcgcatcagaccggtgctcgatttagctgcgtcacgatctctcttggtcttgtcccaggtcaccttgaaggagtctggtcctgtgctggtgaaaccacagagaccctcacgctgacctgcaccatctctggttctctctcaacgatattagaatgggtgtgagctggatccgtcagccccagggaaggccctggagtggcttgcacacatcttctcgaatgacgaaaaatcctacagtacatctctgaagagcagtttaaccatctccaaggacactccaaaggcaggtggtctttagtatgaccaacatggacctgcggacacaggcacatattactgtgcacgggtaatgcggaaagaaacagctggtttctgtattataagtcttacatctggacgtctgggcaaagggaccacggtcaccgtctcctcagcttccaccaagggcccatcggtcttcccctggcgcctgctccaggagcactctggggcacagcggccctgggctgcctggtcaaggactacttcctatatactgtctgagcgggctgcaggcgcatag

SEQ ID NO: 794042 - DNA, 701 bp, Homo sapiens
  misc_feature: 75320.44.36.D03.1.pb.heavy.1.raw 75320
cgtatcgcctccctcgcgccatcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagctgggtttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtcactggggccagggaaccctggtcaccgtctcctcagcctccaccaaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794043 - DNA, 630 bp, Homo sapiens
  misc_feature: 75354.UNK.UNK.UNK.pb.heavy.1.raw 75354
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtagtacgtcgccccagtataatggatgtcaccaatccactccattcccctccctgggggctggccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttgcacatcctgacctccaatccctaatcacgtctgtacactaaatcgagcaccggtcgtgtatatactgtctgatggcgcgagggaggcgatacg

SEQ ID NO: 794044 - DNA, 659 bp, Homo sapiens
  misc_feature: 75356.44.86.H09.1.pb.heavy.1.raw 75356
ctatgcgccttgccaagcccgctcagacagtatataggaagtagtccttgaccaggcagcccagggccgctgtggcccccagaggtgctcctggagcagggcgccagggggaagaccgatgggccctggtggaagctgaggagacagtgaccaggtgccacgggccccatagattgaaagacccagtctcgcctcgcacagaaataaacggccgtgtccgcggcggtcacggaggtcagtttcagggagaagcggttcatggacgtgtccctcgaaatggtgagacgactcttgagggacggagagtagtcgtcgccccagtataatggatgtcaccaatccactccattcccctccctgggggctgccggatccagccccaagaatgatcagaactgatggaaactccagagaccagtgcaggatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcaggaaagcatccccaaacccaagtctatagcactaaatcgagcaccggtcgtgtatatactggtctgatggcgcgaggaggcgatacg

SEQ ID NO: 794045 - DNA, 710 bp, Homo sapiens
  misc_feature: 75373.44.36.D03.1.pb.heavy.1.raw 75373
ctatgcgccttgccagcccgctcagacagtatataggaagtagtccttgaccaggcagcccagggccgctgtgctctcggaggtgctcctggagcaggggcgccagggggaagaccgatgggcccttggtggaggctgaggagacggtgaccagggttccctggccccagtggacagttcctgatataaacacaacacaataataacatgcccgtgtcctcggttttcaggttagtcattcgcagaatcaatgagttcttgaagtcatctcttgagagggtgaatctggctttcacagacgcggcgtactctgtgataaagctggcaacctttgttttactgcggccaagccactccagcccccttccctggagcctggcggacccagtccatatagtggtccactgatggtgaatccaggggcgacacaggagagtctcagggaccctccaggctggaccaagtctcccccggactccaccaactgcacttcactctggacaccttgtaaaataacaacaaggaaaaccagctcagcccgaactccatggtgaggtcctctgtgttcagtgctgatcaccaaatgaaaacacctggggaattctggggctgggctccgctctcagagctccccaaagagagatcgtgacgcagctaaatcgagcaccggtcgtgtatatactgtctgatgcgcgggaggaggcgatacg

SEQ ID NO: 794046 - DNA, 705 bp, Homo sapiens
  misc_feature: 75382.UNK.UNK.UNK.pb.heavy.1.raw 75382
ctatgcgccttgccagcgccgctcagaccagtatataggaagtagtccttggaccaggcagcccagggccggctgtgctctcgaggtgctcctggagcagggcggccaggggggaagaccgatgggcctttggtggaggctgaggagacgggtgaccaggctcgtctgggccccagtagaacgatggggcctcgtacaataaatgagagccgagtctcgggctctcaaattgtcttctatgtagatatcacggtgttctggaattgtctctggagacggagaatcggccccttcacggagtttccatagtatctctttacttccatcagaccagatgactgccacccactccagcccctggctggagcctggcggacccagtgcatggcagagtcactgaaactgagtcggcgacgcaacacaggagagtctcagggacgtccagggctggaccacgcctcccccagactcccaccagctgaacctgacactggacagcctcttaaaagagcaacgaggacgaaaacccagctcagcccaaactccatggtgagtcctctgtgttcagtgctgatcaccgaatggaaacaccgccgacttctagtgctgggctcctctccagccgcctttcccttactgacttcactaaatcgagcacggcggtcgtgtatattactgtctgatggcgcgagggagggcgatacg

SEQ ID NO: 794047 - DNA, 707 bp, Homo sapiens
  misc_feature: 75384.44.39.D06.1.pb.heavy.1.raw 75384
cgtatcgcctccctcgcgccatcagacagtatatacacgaccggtgctcgattagtgacatctcgcagttctttggggagagacgagcccagcactgaagtcgccggtgtttccattcggtgatcatcactgacacagaggactcaccatggagtttgggctgagctgggttttcctcgttgctcttttaagaggtgtccagtgtcaggagcacttggtggagtctggggaggcgtggtccagccgggaggtcctgagactctctcctgtgtagcctctgggttctcattcgatagatttggttgcactgggtccgccaggctccagcaagggccggagtgggtggcagtcatctccgacgatgaagtgagaagtattactcagactccgtgaaggccgattcaccatctccagagacaattccaagaatatgctgtatttgcaatgacagcgtgagagttgacgacacgtctgtttattactgtgcgaggggacctccaaggaaacgttcgggaatcataaactactactatttgatggatgtctgggcaggggacgtcggtcaccgtctcctcagcttccaccaagggcccatcggtcttcccctggcgccctgctccaggagcactctggggcacagcggccctggctgcctggtcaaggactacttcctatatactgtctgagcgggctggcaaggcgcatag

SEQ ID NO: 794048 - DNA, 696 bp, Homo sapiens
  misc_feature: 75387.44.74.G08.1.pb.heavy.1.raw 75387
ctatgcgccttgcagcccgctcagacagtatataggaagtagtccttgaccaggcagcccagggccgctgtgccccagaggtgctcctggagcagggcgccagggggaagaccgatgggcccttggtggaagctgaggtgacaatgaccagggttccctggcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccggaggaccaaggttgcggcattctagtcccagactgcaccagttgcaccagggactggacacctgttgctgctgccaccacaaagagggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggagggcgatacg

SEQ ID NO: 794049 - DNA, 583 bp, Homo sapiens
  misc_feature: 75394.44.78.H01.1.pb.heavy.1.raw 75394
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaa

SEQ ID NO: 794050 - DNA, 707 bp, Homo sapiens
  misc_feature: 75407.44.55.E11.1.pb.heavy.1.raw 75407
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 794051 - DNA, 606 bp, Homo sapiens
  misc_feature: 75428.44.36.D03.1.pb.heavy.1.raw 75428
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggattttcgtcattcgagaagatgtgtgcaagccactccaggccttccctgggggctgacggatccagctcacacccattctaatatcgttgagagagaacccagagatggtgcaggtcagcgtgaggggtctctgtgggtttcaccagcacaggaccagactccttcaaggtgacctgggacaagacccaagagagatcgtgacgcagctaaatcgagcaccggtcgtgtatatactgtctgatggcgcgaggaggcgatacg

SEQ ID NO: 794052 - DNA, 707 bp, Homo sapiens
  misc_feature: 75475.UNK.UNK.UNK.pb.heavy.1.raw 75475
ctatgcgccttgccagccccgctcagacaggtataataggaagtagtccttgaccaggcagcccagggccgctgtgctctcgagggtgtcctggagcaggcgccagggggaagaccgatgggcccttggtggaggccgaggagacggtgaccagggttccctggccccaggcgtcgaatgaaccgattttggaaaacagatagtctcgcacaaaaatacacggccgtgtcctgaggtctcaggcctgttcatttgaaaggacactgtgttctcggaattgtctctggagatggtgaatcggccctcaacggaatcaccgtagacttgatttcctccatgaaatgacacacatgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccgtcgtgtatatactgtctgatggcgcgagggaggcgatacg

SEQ ID NO: 794053 - DNA, 705 bp, Homo sapiens
  misc_feature: 75477.UNK.UNK.UNK.pb.heavy.1.raw 75477
gtatcgcctccctcgcgccatcagacagtatatacacgaccggtggctcgatttagacgcgatcgaagggtttggggcctgggagacgagcccagcactggaagtcgccggtgtttccactcggtgatcatcactgaacacagaggactcaccatggagtttgggctgagctggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccagggctcccaggcgagggctggagtgggtggcaggtggtccatttcatggaggaaatcaagtctacggtgattccgttgaggggccgattcaccattcccagagacattccgagaacacagtgtctcttcaaatgaacagcctgagacctcaggacacggccgtgtatttttgtgcgagactatctgtttccaaaatcggtcattcgacgcctggggccagggaaccctggtccaccgtctcctcggcctccaccaagggcccatcggtcttccccctggcgccctgctccaggagcacctccgagagcacagcgccctggggctgcctggtcaaggactacttcctatatactgtctgagcgggctggcaaggcgcatag

SEQ ID NO: 794054 - DNA, 707 bp, Homo sapiens
  misc_feature: 75544.44.67.G01.1.pb.heavy.1.raw 75544
cgtatcgcctccctcgcgccatcagacagtatatacacgaccggtgctcgatttagagtatacatattgggtttggggggggagaggagcccagcactgggattccgaggtgtttccattcgggtgatcagcactgaacacagaggactcaccatgggagttttggctgagctgggttctccttgttggacttttaaaaggtgtccagtgtgaggtgcggctgatggagtctggaggagcttagtccagcctggggcggtcccagagactctcctgtgcagcctctgggctcaccgtcagcagcaactacatgagttgggtccgcccaggctccagggaaggggctggagtgggtctcagtcatttatactggtgatttcacatactacgcagactccgtgaagggccgattcaccatctccagggacaattccaggaacacggtttatcttcaaatgaacaacctgagagcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctggctgcctggtcaaggactactcctatatactgtctgagcgggctggcaaggcgcatag

SEQ ID NO: 794055 - DNA, 683 bp, Homo sapiens
  misc_feature: 75553.44.27.C05.1.pb.heavy.1.raw 75553
ctatgcgccttgccagcccgctcagacagtatataggaagtagtccttgaccaggcagccaggccgatgtgctctcggaggtgctcctggagcagggcgccaggggagaccgatgggcccttggtggaggccgaggagacggtgaccagggttccctggccccaggcgtcgaatgaccgatttggaacagatagtctcgcacaaaatacacggcgtgtcctgaggtctcaggctgttcatttgaagagacactgtgttctcggaattgtctctgagatggtgaatcgccctcacggatcaccgtagacttgatttcctccatgaaatgacacactgcacccactccagcccctcgctggagcctggcggacccactgcatattccaattatcgaaggtgaatccagaggctgcacaggagagtctcaggaccccctactggggccaccgcctccccagactcacgaattgcacctgacacatgacacctcttaagagggcaacgaggaaaacccagctcagcccaaactccatggtgagtcctctgtgttcagtgatgatcaccgagtggaaacacggcgacttccagtgctgggctcgtctcccagccccaaaaccctcgatcgcgtctaaatcgagcaccggtcgtgtatatactgtctgatggcgcgaggaggcgatacg

SEQ ID NO: 794056 - DNA, 697 bp, Homo sapiens
  misc_feature: 75560.44.6.A06.1.pb.heavy.1.raw 75560
tctatgcgccttgccgcccgctcagacagtataataggaagtagtccttgaccaggcagccccaggccggctgtgcccccagaggtgctcctggagcagggcgccaggggaagaccgatgggcccttggtgggaagctgaggtgacaatgaccaggcgttccctgccccccagatctccaaaggcctccatgcgagctggggtacgggacctctcgcacagtagtagcgacggccgtgtcggtcggatttcaaagaaactcattgtcatggagactcgtggtctgtggacttgtcccgcggtaaatcgtaattcctgccccggaagtctcgtgcgtaggtgagtgagccaaaaagagggatgattccaccccatccactcaagcccttgctccaggggcctggcgcacccagttgatggtataagtagtggaactggtagtacttccagaggccgtgccaggaaagggtcaccgaggaccaaggttgcggcattctagtcccagactgcaccagttgcaccagggactgggacacctgttgctgctgccaccacaaagaggaacctccaggtccagtccatggtgatgagctgtgctcccaggggcttctttagaggaggaatgtggttgtcagtagatctaaatcgagcaccggtcgtgttatatactgtctgatggcgcggagggaggcgatacg

SEQ ID NO: 794057 - DNA, 700 bp, Homo sapiens
  misc_feature: 75569.UNK.UNK.UNK.pb.heavy.1.raw 75569
ctatgcgccttgccaggcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgccctcgcactggacaccttctaaaaaaactacaaggaaaatcaaaagattagcccaaacctccatggttggtggtctgtgctcagtgctgatcaccaagtggaaactcctggaatctcacggctggggctcctctctcttgcgacgacactaaatcggagcaccggtcgtgtatatactgtctgatggcgcgagggaggcgaatacg

SEQ ID NO: 794058 - DNA, 608 bp, Homo sapiens
  misc_feature: 75571.UNK.UNK.UNK.pb.heavy.1.raw 75571
gaaggctgggcaggctatgcaccctggtccaggtcaaaagctgcggaacccgctagcggccatcttggccactaggggtcccgcagattcatattgtcgtctagcatgcacaatgctgcaaaccaagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794059 - DNA, 699 bp, Homo sapiens
  misc_feature: 75578.44.36.D03.1.pb.heavy.1.raw 75578
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcccccaagagagatcgtgacgcagctaaatcgagcaccggtcgtgtatatactgtctgatggcgcgagggaggcgatacg

SEQ ID NO: 794060 - DNA, 718 bp, Homo sapiens
  misc_feature: 75581.UNK.UNK.UNK.pb.heavy.1.raw 75581
cgtatcgccctccctcggcgccatcagacacagttatataacaccgaccggtgctcgatttagtagtcgcataaagggaaagggagctctgagagaggagcccagccctgggattttccgcggtgtcttcatttggtgaccaggaccgaacagagagaagtctccatggagtttgggctgagctgcctttttcttgtggctttttttaaagggtgtcgtgtgtgaagtgcagttgttggagtctggggggggcctgattcggcctgggaggtccctgacctctcctgtgcggcctctgattcacctttagtgcctatgcatgacctgggtccgccgggctccagggagggaactggagtgggtctcaagttatcggagctggtggtgtcactttctacggagactccgtgaagggccgcttcaccatttccagggacaattcgcaggacaaattgtttctccaaatgaaaaacctgagacccgaggacacaggcgtctattactgtttgaaagcccaggaccacggtgacccccatgacaccttttagtacttggggccggggacagtggtgaccgtctcttcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 794061 - DNA, 706 bp, Homo sapiens
  misc_feature: 75605.UNK.UNK.UNK.pb.heavy.1.raw 75605
ctatgcgccttgccagcccgctcagacagtatataggaagtagtccttgaccaggcagcccagggccgctgtgcccccagaggtgctcttggaggagggtgccaggggggaagaccgatgggccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctccttccagactccatcagccgcacctcacactggacacctttttaaaagtccaacaaggagaacccagctcagccaaaactccatggtgagtcctctgtgttcagtgctgatcaccgaatggaaacacctcggaatcccagtgctgggctcctctcccccaaacccaacgtgcgagtgctaaatcgagcaccggtcgtcgtatatactgttgatggcgcgagggaggcgatacg

SEQ ID NO: 794062 - DNA, 606 bp, Homo sapiens
  misc_feature: 75609.UNK.UNK.UNK.pb.heavy.1.raw 75609
gaaggctggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794063 - DNA, 656 bp, Homo sapiens
  misc_feature: 75622.44.86.H09.1.pb.heavy.1.raw 75622
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggggctggatccggcagcccccagggaggggaatggagtgattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggcccctgggctgcctggtcaaggactacttcctatatactgtctgagcgggctggcaaggcgcatag

SEQ ID NO: 794064 - DNA, 696 bp, Homo sapiens
  misc_feature: 75629.44.36.D03.1.pb.heavy.1.raw 75629
cgtatcgcctccctcgcgccatcagacagtatatacacgaccggtgctcgatttagctgcgtcacgatctctcttgggggagagcggagccccagccccagaattcccaggtgttttcatttggtgatcagccactgaacacagaggactcaccatggagttcgggctgagctggttttccttgttgttattttacaaggtgtccagagtgaagtgcagttggtggagtccgggggagacttggtccagcctggaggggtcctgagactctcctgtgtcgcctctggattcaccatcagtgacgcactatatggactgggtccgccaggctccagggaaggggctggagtggcttggccgcagtaaaaacaaagttgccagctttatcacagagtacgccgcgtctgtgaaagccagatcaccctctcaagagatgacttcaagaactcattgattctgcgaatgactacctgaaaaccgaggacacggcatgtattattgtgttgtgtttatatcaggaactgtccactgggggccagggaaccctggtcaccgtctcctcagcctccaccaagggccatcgtcttccccctgacgccctgctccaggagcacctccgagagcacagcggccctgggctgcctggtcaaggactacttcctatatactgtctgagcgggctggcaaggcgcatag

SEQ ID NO: 794065 - DNA, 663 bp, Homo sapiens
  misc_feature: 75635.44.86.H09.1.pb.heavy.1.raw 75635
ctatgcgccttgccagccccgctcagacagtatataggaagtagtcctttgaccaggcagccccagggccgctgtgcccccagaggtgctcctggagcagggcgccaggggaagaccgatgggccttgggtggaaagctgaggagacagtgaccagggggtgccacggccccatagattgaaagaccagtctcgcctcgcacagaataaacggccgtgtccgcggcggtccacggaggtcagtttcagggagaagccggttcatcggacgtgtccctcgaaatggtgagacgactcttgagggacgggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggccgactcctgcagctgcacctgggacaggacccatctgggagctgccaccagcaggaggaaaaaaccacaggtgcttcatgttcttgcacaggagggtccttgactctcagaaaagcatccccaaacccaagtctatagcactaaatcgagcaccggtcgtgtatatactgtctgatggccgagggaggcgatacg

SEQ ID NO: 794066 - DNA, 665 bp, Homo sapiens
  misc_feature: 75652.44.12.B01.1.pb.heavy.1.raw 75652
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcgggcggtcacagagctcagcttcagggagaactggttcttggacgtgtctactgatatggtgactcgactcttgagggacgggttgtagtaggtgctcccactataatagatactcccaatccactccagccccttccctggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 794067 - DNA, 714 bp, Homo sapiens
  misc_feature: 75678.44.62.F07.1.pb.heavy.1.raw 75678
ctatgcgccttgccaagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggcccccccaggactccaacaactgcacttcacacacgacaccctttaaaaaagccacaagaaaaaggcagctcagcccaaactccatggagacttctctctgttcggttcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 794068 - DNA, 667 bp, Homo sapiens
  misc_feature: 75714.UNK.UNK.UNK.pb.heavy.1.raw 75714
ctatgcgccttgccagcccgctcagacagtatataggaagtagtccttgaccaggcagcccagggccgctgtgcccccagaggtgctcctgagcagggcgccaggggggaagaccgatgggccttggtggaagctgaggtgacaatgaccagggttccctgccccagatctcaaaggctccatgcgagctggggtacggacccttcgcacagtagtactgccaagccccgcgccgtgtcgtcggatttcaaagaactcattgtcatggagactgtgtctgtggacttgtcgcgtaatcgtattctgcccgaagtctcgtgcgtaggtgagtgagccaaaagagggatgattccacccatccactcaagcccttgtccagggcctggcgcacccagttgatggtataagtagtggaactggtagtacttcagagccgtgcaggaaagggtcaccgaggaccagttgcggcattctagtcccagactgcaccagttgcacagggactggacacctgttgctgctgccaccacaaagaggaacctccaggtcagtccatggtgatgagctgtgctcccaggggcttcttagaggaggaatgtggttgtcagtagatctaaatcgagcacggtcgtgtatatactgtctgatggcgcgaggaggcgatacg

SEQ ID NO: 794069 - DNA, 704 bp, Homo sapiens
  misc_feature: 75739.UNK.UNK.UNK.pb.heavy.1.raw 75739
cgtatcgcctccctcgcgccattcagacagtatatacacgcggtgctccgattagtgtcgtcgcaagagagaggagccccagccgtgagattcccaggagtttccacttggtgatcagcactgagcacagaccacccaaccatggagtttgggctaaatcttgattttccttgtagttttttttagaagtgtgtccagtgcgaggggcgcgactgcggcgtcgggggggggcttggcacagccagggcggtctctgagactctcctgtgtagtctcaggattcagtcttagtgattatcacttggcctggtccgtcaggctccagggaaggggcttgagtggatcactttcgtagaatgaaacgttatggtggaagtaaagagtacgccgcgtctgtgaagggaagattcaccgtctcaagggatgactccaacagtgtttggccatttacaaaatgagcaacctgagacccgacgacacagggccgtctattactgcgccaggcgatcctgggacgtcgatgcatttgatatttggggccaggggacaatggtcaccgtctcttcagcttccaccaagggcccatcgtcttccccctggcgcccctgctccaggagcacctctggggggcacagcgcccctgggctgcctggtcaaggactacttcctatatactgtctgagcgggctggcaaaggcgcatag

SEQ ID NO: 794070 - DNA, 665 bp, Homo sapiens
  misc_feature: 75750.44.12.B01.1.pb.heavy.1.raw 75750
cgtatcgcctccctcgcgccatcagaacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 794071 - DNA, 606 bp, Homo sapiens
  misc_feature: 75758.UNK.UNK.UNK.pb.heavy.1.raw 75758
cccgacacgcttgctagggacttggagctaaggacgacatattgcctttagacagtcgaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccctagtggccaagatggccgctagcgggttccgcagcttttgacctggaccagggtgcatagcctgcccagccttc

SEQ ID NO: 794072 - DNA, 618 bp, Homo sapiens
  misc_feature: 75760.UNK.UNK.UNK.pb.heavy.1.raw 75760
gaaggctgggcaggctatgcaccctggtccaggtcaaaagctgcggaacccgctagcggccatcttggccactaggcggtcccgcagattcatattgtcgtctagcatgcacaatgctgcaaacccagcttgggcaatgcccacagcaagcggccaatctttacgccacgttgaattgtttattacctggtgactggctatggcttgcaacgccactcgtaaaactagtacttgcggttagggaagtagacaaacccattactccacttccggaagttcaactcattccaacacgaaataaaagtaatcaacccacccccaagcagggctatgtggggggtgattaggggtggattctatttcctatcccatcccctaggatctcaataaagttactagcagttaaatgtcttgtagcgatcccgtcagtcctatcgcgcgcatcaagacctggttggttgagcgtgcagtagatcatcgataagctgcgagtttttaggtcatcccagaccgcatctggcgcctaacgttcaggggtagctaaggcgtcaccttcgacctgtctaaaggcaatatgttcgtcctctagctccaagtcctaggcaagccgtggtcggg

SEQ ID NO: 794073 - DNA, 692 bp, Homo sapiens
  misc_feature: 75761.44.71.G05.1.pb.heavy.1.raw 75761
cgtatcgcctccctcgcgccatcagacagtatatacacgaccggtgctcgatttagtgtcgtcgcaagagagaggagcccagccgtgagatcccaggagtttccacttggtgatcagcactgagcacagaccaccaaccatggagtttgggctaatcttgattttccttgtagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggatcacttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccagggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaaggcgcatag

SEQ ID NO: 794074 - DNA, 608 bp, Homo sapiens
  misc_feature: 75791.UNK.UNK.UNK.pb.heavy.1.raw 75791
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttattgagatcctaggggatgggataggaaatagaatccaccccctatcaccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgttggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794075 - DNA, 669 bp, Homo sapiens
  misc_feature: 75795.UNK.UNK.UNK.pb.heavy.1.raw 75795
ctatgcgccttgccagcccgctcagacagtatataggaagtagtccttgaccaggcagcccagggccgctgtgcccccagaggtgctcttggaggaggtgccagggggaagaaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgatcttgagggacgggttgtagtaggtgctcccactataatagatactccccaatccactccagccccttccctgggggctggcggatccagccccagtagtaactactactgctgatggagccaccagagacagtgcaggtgagggacagggtctccgaaggcttcaccagtcctgggccgactcctgcagctgcagctgggacaggacccatctgggagccgccaccagcaggaggaagaaccacaggtgcttcatgttcttgcacaggaggtccatgactctcagaaagccccgcggacggatctacactactaaatcgagcaccgtcgtgatagtatagagactgatggcggcgcagggaggcgatacg

SEQ ID NO: 794076 - DNA, 643 bp, Homo sapiens
  misc_feature: 75799.UNK.UNK.UNK.pb.heavy.1.raw 75799
cgtatcgcctcctcgcgccatcagacagtatatacacgacggtgctcgattagagtgctacgaaggaaaggggactcctgtgcccaccatggacacacttgctccacgctcctgctgctgaccatcccttcatggtcttgtccagatcacctgaaggagtctggtcctacgctggtgaagcccacacagaccctcacgctgacctgcaacctctctgggttctcactcaggagtgatggagcgattgtgggctgggtccgtcgcccccaggaaagccctggagtggcttgcactcatttattgggatgatgataggcgctacagtccatctctgaagagcagactctccatcaccgagacgcctccaatacgcaggtgatccttagagtggccaacatggcccctgcggacacagccacatactactgcgcacacatgatcaactattataaaagtgtggtatgtgagtggctttgatatctgggccaagggacaatggtcacgtctcttcagcctccaccagggcccatcgtcttccccctggcgcctgctccaggagcacctccgagagcacagcgccctgggctgcctggtcaaggactacttcctatatactgtctgagcgggctggcaaggcgcatag

SEQ ID NO: 794077 - DNA, 675 bp, Homo sapiens
  misc_feature: 75809.44.81.H04.1.pb.heavy.1.raw 75809
cgtatcgcctcctcgcgccatcagacagtatatacacgaccggtgctcgatttagtagtgtagattcgcgggggctttctgagagtcatggacctcctgtgcaagaacatgaagcacctgtggttcttcctcctgctggtggcggctcccagatgggtctgtccagctggcagctgcaggagtccgggcccaggactggtgaagccttcggagacccctgtccctccacctgcactgtctctggtggctccatcagcagtagtagttactaactgggggctggatcccgccagcccccagggaaggggctggagtggattgggaggtatctattatagtggagcacctactacaaacccgtcccttcaagagtccgagtcaccatatcagtagaccacgtccaagaaaccagttctccctgaagctgagctctgtgaccgccgcggacacggccgtgtattactgtgcgagagtagggcagttcgtcaccaactactttgaccactggggccagggaaccctggtcaccgtctcctcaagcctccacaagggcccatcggtcttccccctggcaccctcctccaagagcacctctgggggccacagcggcccctgggctgcctggtcaaggactactttcctatatactgtctgagcgggctggcaggcgcatag

SEQ ID NO: 794078 - DNA, 701 bp, Homo sapiens
  misc_feature: 75814.44.73.G07.1.pb.heavy.1.raw 75814
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagtgtcccctggccccagtgaaacgccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatatgctataactgccaaccactccggccccttgcctggagcctggcggacccagtgcatgccagaactactgaaactaaatccagaggcttcacaggagagtctcagggacctcccaggctggaccacgcctccccagactccaccaggtgcacctgacactggacacctcttaaaagagtaacgaggaaaacccagctcagcccaaactccatggtgagtcctctgtgttcagtgctgatcaccgaatggaaacaccgccgacttctagtgctgggctcctctcccagagctccctgagcgtagagctaaatcgagcaccggtcgtgtatatactgtctgatggcgcgagggaggcgatacg

SEQ ID NO: 794079 - DNA, 651 bp, Homo sapiens
  misc_feature: 75816.44.70.G04.1.pb.heavy.1.raw 75816
cgcctccctcgcgccatcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgccactcacttattggaatgacgatatacgatatagtccttctctgaccgaccagactcacgctcacgaaggacacgtccaaaaaccaggtggtcccttacattgaccaacgtggaccctgtggacacaggcacatatttctgtgcccacttcatgaccacaatgaccacgggcttcttcgaaccctgcgggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794080 - DNA, 611 bp, Homo sapiens
  misc_feature: 75824.UNK.UNK.UNK.pb.heavy.1.raw 75824
gaaggctgggcaggctatgcaccctggtccaggtcaaaagctgcggacccgctagcggccatccttgggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggggtgataggggtggattctatttcctatcccatcccctaggatctcaattaagttactagcgagttaaatgtctgtagcgatcccgtcagtcctatcgcgcgcatcaagacctggttggttgagcgtgcagtagaatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794081 - DNA, 705 bp, Homo sapiens
  misc_feature: 75828.44.36.D03.1.pb.heavy.1.raw 75828
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 794082 - DNA, 700 bp, Homo sapiens
  misc_feature: 75834.44.55.E11.1.pb.heavy.1.raw 75834
ctatgcgccttgccagccgctcagacagtatataggaagtagtccttgaccaggcagcccagggccgctgtgcccccagaggtgctctggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaaccaacgtgcgagtgctaaatcgagcaccggtcgtgtatatactgtctgatggcgcgagggaggcgatacg

SEQ ID NO: 794083 - DNA, 701 bp, Homo sapiens
  misc_feature: 75844.44.27.C05.1.pb.heavy.1.raw 75844
cgtatcgcctccctcgcgccatcagacagtatatacacgaccggtgctcgattagacgcgatcgaagggtttggggagccctggagacgagcccagcactggaagtcgccggtgtttccactcggtgatcatcactgaacaaagaggactcaccatggagtttgggctgagctgggttttcctcgttgccctcttaagaggtgtcatgtgtcaggtgcaattcgtggagtctggggaggcgtggcccagtaggggggtccctgagactctcctgtgcagcctctggatcaccttcgataattggaatatgcagtgggtccgccaggctccaggcgagggctggagtgggtggcaggtgtgtcatttcatggaggaaatcaaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctccaccaagggcccatcggtcttcccctggcgccctgctccaggagcacctcgagagcacagcggccctgggctgcctggtcaaggactacttcctattatactgtctgagcgggctggcaaggcgcatag

SEQ ID NO: 794084 - DNA, 688 bp, Homo sapiens
  misc_feature: 75850.44.74.G08.1.pb.heavy.1.raw 75850
ctatgcgccttgccagcccgctcagacagtatataggaagtagtcttgaccaggcagcccagggccgctgtgcccccagaggtgctcctggagcagggcgccaggggaagaccgatgggcccttggtggaagctgaggtgacaatgaccagggttccctgccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctccaggggcttctttagaggaggaatgtggttgttatgtgatgctcccctgatagagctactaatcgagcaccggtcgtgtatatactgtctgatggcgcgagggaggcgatacg

SEQ ID NO: 794085 - DNA, 713 bp, Homo sapiens
  misc_feature: 75897.UNK.UNK.UNK.pb.heavy.1.raw 75897
cgtatcgcctccctcgcgccatcagacagtatatacacgacggtgctcgattttagcagacgtctgaacacacaaaggggagctctgggagaggagccccagccgtgagattccaggagtttccacttggtgatcagcactgagcacagaccaccaaccatggagtttgggctaatcttgatttttccttgtagttttttttagaaggtgtccagtgcgaggggcgactggcggagtcgggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 794086 - DNA, 703 bp, Homo sapiens
  misc_feature: 75935.44.27.C05.1.pb.heavy.1.raw 75935
cgtatcgcctccctcgcgccatcagacagtatatacacgaccggtgctcgatttagacgcgatcgaagggtttggggagccctgggagacgagcccagcactggaagtcgccggtgttttccactccggtgatcatcactgaacacagaggactcaccatggagtttgggctgagctgggttttcctcgttgccctcttaagaggtgtcatgtgtcaggtgcaattcgtgagtctggggaggcgtggcccccagtagggggggtccctgagactctcctgtgcagcctctgattcaccttcgataattggaatatgcagtgggtccgccaggctccaggcgagggctggagtggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccacaagggcccatcggtcttcccctggcgccctgctccaggagcacctccgagagcacagcggccctggctgcctggtcaaggactacttcctatatactgtctgagcggctggcaaggcgcatag

SEQ ID NO: 794087 - DNA, 690 bp, Homo sapiens
  misc_feature: 75943.44.36.D03.1.pb.heavy.1.raw 75943
cgtatcgcctccctcgcgccatcagacagtatatacacgaccggtgctcgatttagctgcgtcacgatctctcttggggagctctgagagcggagcccagcccagaattcccaggtgttttcatttggtgatcagcactgaacacagaggactcaccatggagttcgggctgagctgggttttcctgttgttattttacaggtgtcagagtgaagtgcagttggtggagtccgggggagacttggtccagcctggaggtccctgagactctcctgtgtcgcctctggattcaccatcagtgaccactatatggactgggtccgccaggctccagggaagggctggagtggcttggccgcagtaaaaacaaagttgccagctttatcacagagtacgccgcgtctgtgaaagccagattcacctctcaagagatgacttcaagaactcattgattctgcgaatgactaacctgaaaaccgaggacacgggcatgtattattgtgttgtgtttatatcaggaactgtccactggggccagggaaccctggtcaccgtctctcagcctccaccaagggcccatcgtcttcccctggcgcctgctcaggagcacctccgagagcacagcggcctgggctgcctgtcaaggactacttcctatatactgtctgagcgggctggcaaggcgcatag

SEQ ID NO: 794088 - DNA, 685 bp, Homo sapiens
  misc_feature: 75973.44.72.G06.1.pb.heavy.1.raw 75973
cgtatcgcctccctcgcgccatcagacagtatatacacgaccggtgctcgatttagctacgactgcaagggaaaggggagagaggagccttagcctggactccaaggcctttccacttggtgatcagcactgagcacagaggactcaccatggaattgggactgagctggttttccttgttgctattttagaaggtgtccagtgtgaggtgcaactggtggagtctggggaggcttggtccagcctggggggtccctgagactctcctgtgcagcctctggattcacctttagtagttattggatgaactgggtccgccaggctccaggaaggggctggagtgggtggccatcatgaagaaagatggaactgagacacactatgtgactctgtgaagggccgattcaccatctccagagacaacgccaagactcactgtatctgcaaatgaacagtctgagagtcgaggacacggctgtgtattattgtgcgggaggcgctgggtggctcattgactactggggtcagggaaccctggtcaccgtctcctcagcctccaccaagggccatcgtcttccccctggcgccctgctccaggagcacctccgagagcacagcggccctgggctgcctggtcaaggactacttcctatatactgtctgagcgggctggcaaggcgcatag

SEQ ID NO: 794089 - DNA, 675 bp, Homo sapiens
  misc_feature: 75975.UNK.UNK.UNK.pb.heavy.1.raw 75975
catcgcgcttgcagcgcgctcagacagtatataggaagtatccttgaccaggcagcccagggccgctgtgccccagaggtgctcctggagcagggcgccaggggaagaccgatgggcccttggtggaagctgaggtgacaatgaccagggttcccctgcccccagatctcaaaggctccatgcgagctgggtacggacctctcgcacagtatgtaggaacggccgtgtcgtcggatttcaaagaactcattgtcatggagactgtggtctgtggacttgtccgcggtaatcgtaattctgcccggaagtctcgtgcgtaggtgagtgagccaaaagagggatgattccacccatcactcaggaccttgtccaggggcctggcgcaccagttgatgtataagtagtgcgaactggtagtacttccaggaggccgtgcaggaaagggtcaccgaggaccaaggttgcggcattctagtcccagacgtgcagcagttgcaccagggactggacagcctgttgctgctgcaccacaaaagaggaacctccagtcatccagtccggtgatgagctgtgctccccaggggcttctttagaggaggaatgtggcttgtcagtagatctaaatcgagcggtcgtcgggtatatactgtctgatggcgcgagggaggcgatacg

SEQ ID NO: 794090 - DNA, 701 bp, Homo sapiens
  misc_feature: 75977.44.55.E11.1.pb.heavy.1.raw 75977
tatcgcctcctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcactacatgagttgggtcgccaggctccagggaaggggctggagtgggtctcagtcattttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctcgcctccaccaaggggccatcggtcttccccctggcaccctcctccaagaggcacctctggggggcacagcggccctgggctgcctggtcaaggactacttcctatatactgtctggagcgggctggcaaggcgcatag

SEQ ID NO: 794091 - DNA, 692 bp, Homo sapiens
  misc_feature: 75980.UNK.UNK.UNK.pb.heavy.1.raw 75980
cgtatgtcgcctccctcggcggccatcagacagtatattacacgaccggtgctcgattttagaatcttactgacaaccacattcctcctctaaagaaggcccctgggagcacagctcatcaccatggactggacctggaggttcctctttggtggtggcaggcagcaacaggtgtccagtccctggtgcaactggtgcagtctgggactagaatgccgcaaccttggtccccggtgaccctttcctgcacggcctctggaagtactaccagttccactacttataccatcaactggtgcgccaggccctggacaagggctttgagtggatggttggaatcattccctctttttggcttcacctcacctacgcacgagacttccggggcagaattacgattaccgcggacaagtccacagacacagtctccatgacaatgaggttcttttgaaaatcgacggacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctggctgcctggtcaagactacttcctatatactgtctgagcgggctggcaaggcgcatag

SEQ ID NO: 794092 - DNA, 638 bp, Homo sapiens
  misc_feature: 75985.UNK.UNK.UNK.pb.heavy.1.raw 75985
cgtatcggcctccctccgcgccatcagacagtatatacgcacgaccggtgctcgatttagtacaacgtgattagggattggggcagggtgaaccacctgtggtttttcctcctgctggtggcagctcccagatgggtcctgtcccaggtgcagctgcaggagtcgggcccaggactggtgaggccttccgggaacccctgtctctcatctgcactgtctctggagttccatcagttctgatcattcttggggctggatccggcagcccccagggagggaatggagtggattggtgacatccattatactgggcgacgtactactctccgtccctcaagagtcgttctcaccatttcgagggaacaccgtccatgaaccgcttctccctgaaactgacctccgtgaccgccgcggacacggccgtttatttctgtgcgaggcgagactcggctctatcatctatgggcgcggtggccaccctggtcactgtctcctcagcttccaccaaagggcccatcggttctttccgccccctggcgccctgctccaggagcacctctggggcacagcggccctgggctgcctggtcaaggactaacttcctatatactgtctgagcgggctggcaaggcgcatag

SEQ ID NO: 794093 - DNA, 730 bp, Homo sapiens
  misc_feature: 76001.44.84.H07.1.pb.heavy.1.raw 76001
cgtatcgcctccctcgcgccatcagacagtatatacacgaccggtgctcgatttagcagacgtctgtcgcgggggagctctgagagaggagcccagccctgggattttcaggtgttttcatttggtgatcaggactgaacagagagaactcaccatggagtttgggctgagggtggctttttcttgtgactattttaaaagggtgtccagtgtgaggtggccctgttggagtctctgggggaggattggcacagcctggggggtccctgagactctcctgtggcaggccctctggcttcccctttaggagctatgccatgacctgggtccgccaggctccagggaagggctcgagtgggtctcgacaattggcgctagtgcaactgacacatactacggagagtccgtgaaggggccgcttcaccatctccagagacaattccggaaacacactttttctggaaatgaacagcctgagagtcgaagacacggccctttatttctgtgcgaagaggggggggggactggatccacagtgggtgggtggttgcaactcctggggccagggagccctggtcaccgtcgccgcaggcctcccaccaagggcccatcccggtcttccccctggcaccctcctccaagagcacctctgggggcacagcggccctgggctgcctggtcaaggactacttcctatatactgtctgagcgggctgggcaaggcgcatag

SEQ ID NO: 794094 - DNA, 674 bp, Homo sapiens
  misc_feature: 76002.44.6.A06.1.pb.heavy.1.raw 76002
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtacccagctcgcatggagcctttgagatctgggggcagggaaccctggtcattgtcaccctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794095 - DNA, 607 bp, Homo sapiens
  misc_feature: 76004.UNK.UNK.UNK.pb.heavy.1.raw 76004
gaaggctgggcaggctatgcaccctggtccaggtcaaaagctgcgaacccgctagcgcggccatcttggccactaggggtccgcagattcatattgtcgtctagcatgcacaatgcgcaaacccagcttgcaatgcccacagcaaggcggccaatctttacggccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggattctatttcctatccatcccctaggatctcattaagttacctagcgagttaaatgtctgtagcgatcccgtcagtcctatcgcgcgcatcaagacctggttggtgagcgtgccagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794096 - DNA, 705 bp, Homo sapiens
  misc_feature: 76010.UNK.UNK.UNK.pb.heavy.1.raw 76010
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgaggcaccggtcgtgtatatactgtctgatggcgcgagggaggcgatacg

SEQ ID NO: 794097 - DNA, 715 bp, Homo sapiens
  misc_feature: 76028.44.27.C05.1.pb.heavy.1.raw 76028
ctatgcgccttgccagcccgctcagacagtatataggaagtagtccttgaccaggcagcccagggccgctgtgctctcggaggtgctcctggagcagggcgccagggggaggaccgatggcccttggtggaggccgaggaggacggtgaccagggttccctggccccaggcgtcgaatgaaccgatttttggaaacagatagtctcgcacaaaaaatacacggccgtgtcctgaggtctcaggctgttcatttgaaagagacactgtgttctcggaattgtctctggagatggtgaatcggccctcaacggaatcaccgtagacttgattttcctccatgaaatgacacacctgccacccactccagccctcgcctggagcctggcggacccactgcatatttccaattatcgaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccggagtggaaacacaccggcgacttccagtgctgggctcgtctcccagggctccccaaacccttcgatcgcgtctaaaatcgagcaccggtcgtgtatatactgtctgatggcgcgagggaggcgatacg

SEQ ID NO: 794098 - DNA, 633 bp, Homo sapiens
  misc_feature: 76033.44.86.H09.1.pb.heavy.1.raw 76033
cgtatcgcctccctcgcgccatcagaccagtatatacacgaccggtgctcgatttagtgctatagacttgggttttggggatgctttctgagagtcaaggacctcctgtgcaagaaacatgaagcacctgttggtttttcctcctgctggtggcagctcccagatgggtcctgtcccagggtgcagctgcaggagtcgggcccaggacctggtgaggccttcgggaaccctgtctctcatctgcactgtctctggagtttccatcagtttctgatcattcttggggctggatccggcagcccccagggaggggaatggagtggattggtgacattccattatactggggcgacgtactactctccgtccccaagagtcgtctcaccatttcgaggacacgtccatgaaccgcttctccctgaaactgacctccgtgaccgccgcggacacggccgtttatttctgtgcgaggcgagactggtctttcaatctatggggccgtggcaccctgggtcacctgtctcctcagcttccaccaagggcccatcggtcttccccctggcgcccctgctccaggagcacctctgggggcacagcggccctgggctgcctggtcaaggactacttcctata

SEQ ID NO: 794099 - DNA, 706 bp, Homo sapiens
  misc_feature: 76037.44.36.D03.1.pb.heavy.1.raw 76037
ctatgcgccttgccagccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggcccccagtggacagttcctgatataaacacaacacaataatacatgcccgtgtcctcggttttcaggttagtcattcgcagaatcaatgagtttcttgaagtcatctcttgagagggtgaatctggctttcacagacgcggcgtactctgtgataaagctggcaactttgtttttactgcggccaagccactccagcccttccctggagcctggcggacccagtccatatagtggttcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgaagggaggcgatacg

SEQ ID NO: 794100 - DNA, 672 bp, Homo sapiens
  misc_feature: 76042.UNK.UNK.UNK.pb.heavy.1.raw 76042
catgcgcctgccagcccggctcagacagtatataggaagtagtccttgaccggcagcccagggccgctgtgcccccagaggtgctcttggaggagggtgccagggggaagaccgatgggccccttggtggaggctgaggagacggtgaccagggttccctggccccagtggtcaaagtagttggtgacgaactgccctactctcgcacgcagtaatacacggccgtgtccgcggcgcggtcacagagctcagcttcagggagaactggttcttggacgtgtctactgatatggtgactcgactccttgagggacgggttgtagtaggtgctcccactataatagatactcccaatccactccagccccttccctgggggctggcggatccagccccagtagtaactactactgctgatggagcccaccagagacagtgcaggtgagggacgggggtctccgaaggcttcaccagtcctgggcccgactcctgcagctgcagctgggacagcgacccatctgggagccgccaccagcaggaggaagaaccacaggtgcttcatgttcttgcacaggaggtccatgactctcagaaagcccccgcggaatctacactactaaatcggcaccggtcgtgtatatactgtctgatggcgccgagggaggcgatacg

SEQ ID NO: 794101 - DNA, 702 bp, Homo sapiens
  misc_feature: 76044.44.55.E11.1.pb.heavy.1.raw 76044
cgtatcgccttcgcctcgcgccatcagacagtatatacacgaccggtgctcgatttagcactcgcacgttgggtttggggagaggagcccagcactgggattccgaggtgtttccattcggtgatcagcactgacacagaggactcaccatggagttttggctgagctgggttctccttgttggacttttaaaaggtgtccagtgtgaggtgcggctgatgagtctggaggaggctagtccagcctggggggtcccagagactctcctgtgcagcctctgggctcaccgttcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794102 - DNA, 704 bp, Homo sapiens
  misc_feature: 76047.UNK.UNK.UNK.pb.heavy.1.raw 76047
cgtatcgcctccctcgcgccatcagacagtatatacccgaccggtgctcgatttagctgcgtcacgatctctcttggagctctcagagagtgccttagcctggattccaaggcatttccacttggtgatcagcactgaacacagaggactcaccatggagttggggctgcgctgggtttgccttgttgctattttagaggtgtccactgtgaggtgcggctggtggagtctgggaggcttggtacagcgggggggtccctgagactctcctgtgcagcctctggattcatcttcagtgactatgccatgaactgggtccgccaggctccagggaaggggctggagtgggtttcatatgttaatattgctggagataccacctactacgcagactctgtgaagggccgatcaccaattcccagggacaatgccaagactcactgtatctggaaatgacagcctgagagacgaggacacggctgtctacttctgttcgagagatcgggccacttggtcagtggctggtttgactactgggggccggggaaccctggtcaccgtctcctcagcctccaccaagggcccatcggtcttccccctggcgccctgctccaggagcacctccgagagcacagcggccctgggcctgcctggtcaaggactacttcctatatactgtctgagcgggctggcaaggcgcatag

SEQ ID NO: 794103 - DNA, 703 bp, Homo sapiens
  misc_feature: 76057.UNK.UNK.UNK.pb.heavy.1.raw 76057
ctatgcgccttgccagcccgctcagacaggtatataggaaagtagtccttgaccaggcagcccagggccgcttgtgctctcggaggtgctcctggagcaggcgccagggggaagaccgatgggcccttggtggaggctgaggagacggtgaccagggttccctgaccccagtagtcaatgagccacccagcgcctcccgcacaataatacacagccgtgttcctcgactcttcagactgttcatttgcagatacagtgagttcttggcgttgtctctggagatggtgaatcggcccttcacagagtccacatagtgtgtctcagttccattctttctttcatgatggccacccactccagccccttccctggagcctggcggacccagttcatccaataactactaaaggtgaatccagaggctgcacaggagagttctcagggacccccccaggctggaccaagcctccccagactccaccagttgcacctcacactggacaccttctaaaatagcaacaaggaaaaaacccagctccagtcccaattccatggtgagtcctctgtgctcagtgctgatcaccagtggaaaggccttggagtccagggctaaggctcctctctccctttcccttgcagtcgtagctaaatcgagccaccggtcgtggtatatactgtctgatggcgcgagggaggcgatacg

SEQ ID NO: 794104 - DNA, 695 bp, Homo sapiens
  misc_feature: 76062.44.36.D03.1.pb.heavy.1.raw 76062
ctatgcgccttgccagcccgctcagacagtatataggaagtagtccttgaccaggcagcccagggccgctgtgctctcggaggtgctcctggagcagggcgccaggggaagaccgatgggccccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataagctggcaactttgttttactgcgccaagccactccagcccttcctggagcctggcggacccagtccatatagtggtcactgatggtgaatccagagcgacacaggagagtctcagggaccctccaggctggaccaagtctcccccgactccaccaactgcacttcactctggacaccttgtaaaataacaacaaggaaaacccagctcagcccgaactccatggtgagtcctctgtgttcagtgctgatcaccaaatgaaaacacctggaattctggggctgggctccgctctcagagctccccaagagagatcgtgacgcagctaaatcgagcaccggtcgtgtatatactgtctgatggcgcgagggaggcgatacg

SEQ ID NO: 794105 - DNA, 690 bp, Homo sapiens
  misc_feature: 76068.44.74.G08.1.pb.heavy.1.raw 76068
ctatgcgcctgccagcccgctcagacgtaataggaagtagtccttgaccaggcagcccagggccgctgtgcccccagaggtgctcctggagcagggcgccagggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgcccggaagtctcgtgcgtaggtgagtgagccaaaaagagggatgattccacccatccactcaagcccttgtccaggggcctggcgcacccagtgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgataacg

SEQ ID NO: 794106 - DNA, 669 bp, Homo sapiens
  misc_feature: 76075.44.12.B01.1.pb.heavy.1.raw 76075
ctatgcgccttgccagcccgctcagacagtatataggaagtagtcccttgaccaggcagccagggcgctgtgcccccagaggtgctcttggggagggtgccagggggaagaccgatgggcccttggtggaggctgaggagacggtgaccagggtttccctggcccagtggtcaaagtagttggtgacgaactgccctactctcgcacagtaatacacggccgtgtccgcggcggtcacagagctcagcttcagggagaactgggttcttggacgtgtctactgatatggtggactcgacctcttgagggacgggttgtagtaggtgctcccactataatagatactcccaatccactccagccccttccctgggggctggcggatccagccccagtagtaactactactgctgatggagccaccagagacagtgcaggtgagggacagggttctccgaaggcttcaccagtcctgggcccgactcctgcagctgcagctgggacaggacccatctgggaggccgccaccagcaggaggaagaaccacaggtgcttcatgttcttgcacaggaggtccatgactctcagaaaagccccgcggaatctacactactaaatcgagcaccggtcgtgtatatactgttctgatgcgcgagggagggcgatacg

SEQ ID NO: 794107 - DNA, 610 bp, Homo sapiens
  misc_feature: 76077.UNK.UNK.UNK.pb.heavy.1.raw 76077
acccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgttgagtttacttttatttcgtgttggaatgagttgaaacttccgggaagtggagtaatgggtttgtctacttcccctaaccgcaaagtactagttttacgagtggcgttgcaagccatagccagtcacaggtaataaacaattcaaacgtggcgtaaagattggccgcttgctgtggcattgcaagctgggtttgcagcattgtggcatgctagacgacaatatgaatctgcgggacccctagtggccaagatggccgctagcgggttccgcagcttttgacctggaccagggtgcaaagcctgcccagccttc

SEQ ID NO: 794108 - DNA, 572 bp, Homo sapiens
  misc_feature: 76107.44.36.D03.1.pb.heavy.1.raw 76107
cgtacgctccctcgcgccatcagacagtatatacacgaccggtgctcgatttagctgcgtcacgatctctcttggggacccagcttctgatgactctcctgttgccagcgtcatggcctcagtgaaggtctcctgcaaagctctggatacaccttcgccagctacgacattcactgtgtgtgacaggcccctggataagggtttgaatggatggtagggaggctactctggcaatggtaacacaggctatgcacagaagtttcagggcagagtcaccatgaccagggacacgtccacgagcacagcctacatggagctgagcagtcagagatctgaggacatagatgtgtactactgtgcgagaccggtagaggacaagcaagaaaagaagttctttttgactactggggccagggaaccctggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 794109 - DNA, 702 bp, Homo sapiens
  misc_feature: 76127.UNK.UNK.UNK.pb.heavy.1.raw 76127
ctatgcgccttgccagcccgctcagacagtatataggaagtagtccttgaccaggcagcccaggccgctgtgcccccagaggtgctcttggaggagggtgccaggggaagaccgatgggcccttggtggaggcggagcgacggtgacccaggttccctggccccagaagtcaacgataatcacaaccactccgagcgccgacttgtctcgcacagtaatagacggccgtggtcgccctctcaggttgttcatttgaaaataaaccgtgttcctggaattgtccctggagatggtgaatcggcccttcacggagtctgcgtagtatgtgaaatcaccagtataaatgactgagacccactccagcccctttccctggagcctggcgaacccaactcatgtagttgctgctgacggtgagcccagaggctgcacaggagagtctctgggaccccccaggctggactaagcctcctccagacttccatcagccgcacctcacactggacaccttttaaaagtccaacaaggagaaccagctcagcaaaaactccatggtgagtcctctgtgttcagtgctgatcacgaatggaaacacctcggaatcccagtgctgggctcctctccccccccaaacccaacgtgcgagtgctaaatcgagcaccgtcgtgtatatactgtctgatggcgcgaggaggcgatacg

SEQ ID NO: 794110 - DNA, 647 bp, Homo sapiens
  misc_feature: 76128.UNK.UNK.UNK.pb.heavy.1.raw 76128
cgtatcgcctcctcgcgccatcagacagtatatacacgaccggtgctccgatttagtacacgtgattagggatttgggggctttctgagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgaggacacgtccatgaaccgcttctccctgaaactgactccgtgaccgcgcggacacggccgtttatttctgtgcgaggcgagaactggtctttcaatctatggggccgtggcaccctggtcactgtctcctcagcttcaccaagggcccatcggtcttcccctggcgccctgctccaggagcacctctggggggcacagcggccctgggctgcctggtcaaggactactctattactgtctgagcgggctggcaaggcgcatag

SEQ ID NO: 794111 - DNA, 694 bp, Homo sapiens
  misc_feature: 76154.UNK.UNK.UNK.pb.heavy.1.raw 76154
ctatgcgccttgccagcccgctcagacagtatataggaagtagtccttgaccaggcagcccagggccgctgtgccccagaggtgctcttggaggagggtgccagggggaagaccgatgggcccttggtggaggcggaggcgacggtgaccagggttcctggccccagaagtcaaacgaataataaccactccgagcgccgacttgtctcgcacagtaatagacgccgtgtcgtcgcctctcaggttgttcatttgaagataaaccgtgttcctggaattgtccctggagatggtgaatcggcccttcacgagtctgcgtagtatgtgaaatcaccagtataaatgactgagacccactccagccccttccctggagcctggcggacccaactcatgtagttgctgctgacggtgagccagaggctgcacaggagagtctctggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaacccaacgtgcgagtgctaaatcgaacaccgtcgtgtatatactgtctgatggcgcgaggaggcgatacg

SEQ ID NO: 794112 - DNA, 665 bp, Homo sapiens
  misc_feature: 76158.UNK.UNK.UNK.pb.heavy.1.raw 76158
cgtatcgcctccctcgcgccatcagacagtatatacacgaccggtgttcgattttgatcacataacaaccacactcctcctctaaagaagccctgggagcacagctcatcaccatggactggacctggcgttcctctttgtggtggcagcagctacagtgtccagtcccaggtgcagctgggcagtctgggctgagtgaagaagcctgggtcctcggtgaaggtctctgcaaggcttctggaggcaccttcttcagctatgcttttatttgggtgcgacaggcccctggacaagggcttgagtgctggagggatcatcctatctttggtgcatcgaattacgcacagaagtttcaggacagagtcaccattaccgcggacgaatccacgagtacagcctacatggagctgagcaggctgagatctgaagacacggccatctatttctgtgcgagagcctcgtcaactttcatagtccctctcatagtcccacacatggaaattggttcgacccctggggccagggaaccctggtcaccgtctcctcagcttccaccaaggcccatcggtcttccccctggcgccctgctccaggagcactctgggggcacagcggccctgggctgcctggtcaaggactacttcctatatactgtctgagcgggc

SEQ ID NO: 794113 - DNA, 705 bp, Homo sapiens
  misc_feature: 76175.44.36.D03.1.pb.heavy.1.raw 76175
cgtatcgcctccctcgcgccatcagacagtatatacacgaccggtgctcgatttagctgcgtcacgatctctcttgggggagctctgagagcggagccccagcccagaattcccaggtgtttcatttggtgatcagcactgaacacagaggacttcaccatggagttcgggctgagctgggtttccttgttgttattttacaaggtgtccagagtgaagtgcagttggtggagccgggggagacttggtccagcctggagggtccctgagactctcctgtgtcgcctctggatcaccatcagtgaccactatatggactggtccgcccaggctccagggaaggggctggagtggcttggccgcagtaaaaacaaagtgccagcctttatcacagagtacgccgcgtctgtgaaagcccagatttcaccctctcaagagatgacttcaagaactcattgattctgcgaatgactaacctgaaaaaccgaggacaacgggcatgtattattgtgttgtgtttatatcaggaactgtccactgggccagggaaccctggtcaccgtctcctcagcctccaccaagggcccatcgtcttccccctggcgccctgctccaggagcacctccgagagcacagcggccctgggctgcctggtcaaggactacttcctatatactgtctgagcggggctggcaaggcgcatag

SEQ ID NO: 794114 - DNA, 632 bp, Homo sapiens
  misc_feature: 76177.44.23.C01.1.pb.heavy.1.raw 76177
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctctatatactgtctgagcgggctggcaaggcgcatag

SEQ ID NO: 794115 - DNA, 661 bp, Homo sapiens
  misc_feature: 76198.44.86.H09.1.pb.heavy.1.raw 76198
cgtatcgcctccctcgcgccatcagacagtatataccacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtccggcccaggactggtgaggccttcgggaaccctgtctctcatctgcactgtctctggagttttccatcagttctgatcattcttggggctggatccggcagcccccagggaggggaatggacgatggattggtgacatccattatactggggcgacgtactactctccgtccctcaagagtcgtctcaccattttcgagggacacgtccatgaaccggcttctccctgaaaactgacctccgtgaccgccgcggacacggccgtttatttctgtgcgagggcgagactggtctttcaatctatggggccgtggcaccctggtcactgtctcctcagcttccaccaaggcccatcggtcttccccctggcgcccctgctccaggagcacctctgggggcacagcggcctggctgcctggtcaaggactacttccctatatactgtctgagcggctggcaaggcgcatag

SEQ ID NO: 794116 - DNA, 611 bp, Homo sapiens
  misc_feature: 76208.44.36.D03.1.pb.heavy.1.raw 76208
cgtatcgcctccctcgcgccatcagacagtatatacacgaccggtgctcgatttagctgcgtcacgatctctcttgggtcttgtcccaggtcaccttgaagggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctgggggcaaaagggaccacggtcaccgtctcctcagcttccacaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794117 - DNA, 711 bp, Homo sapiens
  misc_feature: 76210.44.36.D03.1.pb.heavy.1.raw 76210
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggcttttcacagacgcggcgtactctgtgataaagctggcaactttgtttttactgcgggccaagccactccaggccccttccctggagcctggcggacccagtccatatagtggtcactgatggtgaatccagaggcgacacaggaggagtctcagggaccctccaggctggaccaagtctcccccggactccaccaactgcacttcactctggacaccttgtaaaataacaacaggaaaacccagctcagcccgaactccatggtgagtcctctgtgttcagtgctgaatcaccaaatgaaaacacctgggaattctggggctggggctccgctctcagagctccccaagaagagatcgtgacgcagctaaatcgagcaccggtcgtgtatatactgtctgatggcgccgagggaggcgatacg

SEQ ID NO: 794118 - DNA, 705 bp, Homo sapiens; identical to SEQ ID NO: 790895
  misc_feature: 76212.44.36.D03.1.pb.heavy.1.raw 76212

SEQ ID NO: 794119 - DNA, 727 bp, Homo sapiens
  misc_feature: 76214.44.39.D06.1.pb.heavy.1.raw 76214
cgtatcgcctccctcgcgccatcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctctttttaagaggtgtccagtgtcaggagcacttggtggagtctgggggaggcgtggtccagcccggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctggctgcctggtcaaggactacttcctatatactgtctgagcgggctggcaaggcgcatag

SEQ ID NO: 794120 - DNA, 706 bp, Homo sapiens
  misc_feature: 76224.44.62.F07.1.pb.heavy.1.raw 76224
cgtatcgcctccctcgcgccatcagacagtatatacacgaccggtgctcgatttagtagtcgcataaagggaaagggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctgggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgacccccatgacacctttagtacttggggccggggacagtggtgaccgtctcttcagcctccaccaagggcccatcggtcttccccctggcgccctgctccaggagcacctcgagagcacagcggcctgggctgcctggtcaaggactacttcctatatactgtctgagcgggctggcaaggcgcatag

SEQ ID NO: 794121 - DNA, 615 bp, Homo sapiens
  misc_feature: 76225.UNK.UNK.UNK.pb.heavy.1.raw 76225
cccgacacgcttgcttagggacttggaagctaaggacgacatattgcctttagacagtcgaaggtgacgccttagctaccactgaacgtttaggcgccagatgcggtctgggatgacctaactccgcagcttatcgatgatcttacctgcacgctcaaccaaccaggtcttgatgcgcgcgataggactgacgggatcgcttacagacatttaactcgctagtaacttaattgagatcctaggggatgggataggaaaatagaaatccacccctatcaccccccacatagcctgcttggggtgttgagtttacttttatttcgtgttggaatgagttgaacttccggggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgcccagacgacaatatgaatctgcgggacccctagtggccaagatggccgctagcggttccgcagcttttgacctggaccaggtgcatagcctgcccagccttc

SEQ ID NO: 794122 - DNA, 591 bp, Homo sapiens; identical to SEQ ID NO: 791704
  misc_feature: 76227.44.78.H01.1.pb.heavy.1.raw 76227

SEQ ID NO: 794123 - DNA, 568 bp, Homo sapiens
  misc_feature: 76247.44.36.D03.1.pb.heavy.1.raw 76247
cgtatcgcctccctcgcgccatcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagacggtagaggacaagcagaaaagaagtcttttgactactggggccagggaaccctggtcaccgtctcctcagcctccaccaagggcccatcggtcttcccctggcaccctcctccaagagcacctctggggcacagcggccctggctgcctggtcaaggactacttcctatatactgtctgagcgggctggcaaggcgcatag

SEQ ID NO: 794124 - DNA, 615 bp, Homo sapiens
  misc_feature: 76248.UNK.UNK.UNK.pb.heavy.1.raw 76248
ctatgcgccttgccagcccgctcagacagtatataggaagtagtccttgaccaggcagcccagggccgctgtgccccagaggtgctcctggagccagggcgccaggggggaagaccgatgggcccttggtgggaagctgaggagacggtgaccgtggtccctttgcccccagacgtccagatggtaagacttataatcacagaaaccagctgtttctttcccgcattacccgtgcacagtaatatgtgcctgtgtccgcaggtccatgttggtcatactaaagaccacctgccttttggaggtgtccttggagatggttaaactgctcttcagagatgtactgtaggatttttcgtcattcgaggaagatgtggggcaagccactccaggccttcctgggggctgacggatccagctcacacccattctaatatcgttgagagagaacccagagatggtgcaggctcacggcgtgagggtctctgtgggtttcaccagcacaggaccagactccttcaaaggtgacctgggacaagacccaagagagatcgtgacgcaggctaatcgagcacccgtcgtgtatatactgtctgatggcgcgagggaggcgatacg

SEQ ID NO: 794125 - DNA, 707 bp, Homo sapiens
  misc_feature: 76258.UNK.UNK.UNK.pb.heavy.1.raw 76258
cgtatcgcctccctcgcgccatcagacagtatatacacgaccggtgctcggatttagtgtcgtcgcaagagagaggagccccagccgtgagattcccaggagtttccacttggtggatcagcactgagcacagacccaccaaccatggagtttgggctaatcttgattttccttgtagtttttttttagaaggtgtccagtgcgagggcgactggcggagtcggggggggggcttggcacagccagggcggtctctgagactctcctgtgtagtcctcaggattcagtcttagtgattatcacttggcctgggtccgtcaggctccagggaaggggcttgagtggatcactttcgtcagaatgaaacgttatggtggaagtaaagagtacgccggcgtctggtgaaggaagattcaccgtctcaagggatgactccaacagtgttggccatttacaaatgagcaacctgagacccgacgacacaggcgtctattactgcgccaggcgatcctgggacgtcgatggcatttgatatttggggccaggggacaatggtcaccgtctctttcagcttccacccaagggcccatcggtcttcccctggcgcccctgctccaggagcacctctggggggcacagcggccctgggctgcctggtcaaggactacttcctatatactgtctgagcgggctggcaaggcgcatag

SEQ ID NO: 794126 - DNA, 667 bp, Homo sapiens
  misc_feature: 76259.UNK.UNK.UNK.pb.heavy.1.raw 76259
cgtatcgcctcctcgcgccatcagacagtatatacacgaccggtggctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctgggaggggggcttagtccagcctgggggtcccagagactctcctgtgcagcctctgggctcaccgtcagcagcaactacattgagttgggtccgccaggctccaggaaggggctggagtgggtctcagtcatttatactggtgatttcacatactaccgcagactccgtgaagggcgattcaccatctccagggacaattccaggaacacggtttatcttcaatgaacaacctgagaggcgacgacacggccgtctattactgtgcgagacaagtccggcgctcggagtggttattattcgtttgacttctggggccagggaaccctggtcaccgtcgcctccgctccaccaaggggcccatcggtcttcccctggcaccctcctccaagagcacctctgggggcacagcggcctgggctgcctggtcaaggactacttcc

SEQ ID NO: 794127 - DNA, 683 bp, Homo sapiens
  misc_feature: 76274.UNK.UNK.UNK.pb.heavy.1.raw 76274
cgtatcgcctccctcgcgccatcagacagtatatacacgaccgtgctcgattagtagctctatcagggggagcatcacataacaaccacattcctcctctaaagaagcccctggggcaacaggctcatcacccatggactggacctggaggttcctctttgtggtggcagcagcaacaggtgtccagtccctggtgcaactggtgcagtctgggactagaatgccgcaaccttggtcctcggtgaccctttcctgcacggcctcctggaagtactaccagttccactacttataccatcaactgggtgcgccaggccctggacaaagggcttgagtgatgggtggaatcatccctctttttggctcactcacctacgcacgagacttcgggggcagaattacgattacgcgcgacaagtcacagacacagtctccatgacaatgattctttgaatccgacgacacgccgtctactactgtgcgagaggtccgtaccccagctcgatggagcctttgagatctgggggcagggaaccctggtcattgtcacctcagcttccacaagggcccatcggtctttcccctggcccctgctccaggagcacctcggggcacagcggccctggctgcctggtcaagactacttcctatatactgtttctgagcggctgcaaggcgcatag

SEQ ID NO: 794128 - DNA, 737 bp, Homo sapiens
  misc_feature: 76289.44.85.H08.1.pb.heavy.1.raw 76289
ctatcgcgcctgcagcccgcctcagacagttataggtaggaagtcagcgccgttaccaggcggcccggccgctgtgcccccagaggtgctcttggaggaggcgccagggaagaccgatggcccttggtggaggctgaggagagccggtgacccgtggtcccttggccccagacgtccataccgtagtagtagtcccagcaggtggtaggtactacaatatgtcctcgcacagtaatacacagccgtgtcctcggctctcaggctgttcatttgcagatacagcgtgttcttggaattgtctctgcggagatggtgaatcggcccttcacggagtctgcatagtatttattacttccatcataccatataagtgccaccactcaggcccttgcctggagcctggcggacccagtgcatgccataggtactgaaggtgaatccaggacgctgcaccaggagagtctcagggacctcccaggctggaccacgccctcccccccagactccaccagctgcacctgacactggacacctcttaaaagagcaacgaggaaaacgccagctcagccgcaaactccatgtgagtcctctgtgttcagtgctgatcaccgaatggaaacaccgccgacttctagtggctgggctcctctcccagagctccccgcgactgagtgatactaaatcgagcaccggtcgtgtatatactggtctgatggcgccgagggaggcgataccga

SEQ ID NO: 794129 - DNA, 678 bp, Homo sapiens
  misc_feature: 76295.44.86.H09.1.pb.heavy.1.raw 76295
cgtatcgcctccctcgcgccatcagacagtatatacacgaccggtgctcgattttagtgctatagacttgggtttggggatgcttttctgagagtcaaggacctcctgtgcaagaacatgaagcacctgtggtttttcctcctgctggtggcagctcccagatgggtccctgtccaggtgcagctgcaggagtcgggcccaggactggtgaggccttcgggaaccctgtctctcatctgcactgtcctctggagtttcccatcagttctgatcattcttggggctggatccggcagccccaggaggggaatggagtggaattgggtgacatccaatttatactggggcgacgtactactctccgtccctcaagaagtcgtctcaccatttcggagggacacgtccatgaaccgcttctccctgaaactgacctcccgtgaccgccgcggaacacggcccggttatttctgtgcgaggcggagactggtctttcaatctatgggggccgtgggccaccctggtcactgtctcctttcagcttccaccaaagggcccatcggttccttccccctggccgccctgctccaggagcacctctggggcacagcgggccctgggctgcctggtcaaggactacttcctatatactgtctgagcgggctggcaagggcgcaatag

SEQ ID NO: 794130 - DNA, 723 bp, Homo sapiens
  misc_feature: 76323.44.85.H08.1.pb.heavy.1.raw 76323
cgtatcgcctccctcgcgccatcagacagtatatacacgaccggtgctcgatttagtatcactcagtcgcggggagctctgggagaggagcccagcactagaagtcggcggtgttttccattcggtgatcagcactgaacacagaggactcaccatggagtttgggctgagctggttttcctcgttgctctttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtggggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctggggcacagcggccctgggctgcctggtcaaggaactacttcctatatactgtctgagcgggctggcaaggcgcatag

SEQ ID NO: 794131 - DNA, 710 bp, Homo sapiens
  misc_feature: 76336.44.55.E11.1.pb.heavy.1.raw 76336
cgtatcgcctccctcgcgccatcagacagtatatacacgaccggtgctcgatttagcactcgcacgttgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggaggtctggaggaggcttagtccagcctggggggtcccagagactctcctgtgcagcctctgggctcaccgtcagcagcaactacatgagttttgggtccgccaggctccagggaaggggctggagtgggtctcagtcatttatactggtgatttcacatactacgcagactccgtgaaggccgattcaccatctccagggacaattccaggaacacggtttatctttcaaatgaacaacctgagaggcgacgacacggccgtctattactgttgcgagacaagtcggcgctcggagtggttattattcgtttgacttctggggccagggaaccctggtcaccgtcgccctccgcctccaccaagggcccatcggtcttccccctggcaccctcctccaagagcacctctgggggcacagcggccctgggctgcctgggtcaaggactacttcctatatactgtctgagcgggctggcaaggcgcatag

SEQ ID NO: 794132 - DNA, 698 bp, Homo sapiens
  misc_feature: 76348.44.55.E11.1.pb.heavy.1.raw 76348
cgtatcgcctccctcgcgccatcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaatccaggaacacggtttatcttcaaatgaacaacctgagaggcgacgacacggccgtctattactgtgcgagacaagtcggcgctcggagtggttattattcgtttgacttctgggccaggaaccctggtcaccgtcgcctccgcctccaccaaggcccatcggtcttcccctggcaccctcctccaagagcacctctgggggcacagcggccctgggctgcctggtcaaggactacttcctatatactgtctgagcgggctggcaaggcgcatag

SEQ ID NO: 794133 - DNA, 710 bp, Homo sapiens
  misc_feature: 76361.44.55.E11.1.pb.heavy.1.raw 76361
ctatggcgccttgccagcccgctcagacagtatataggaagtagtccttgaccaggccagcccagggccgcgtgccccccagaggtgctcttggaggagggtgccaggggcgaaagcgatgggcccttggtggaggcggaggcgacggtgaccagggttccctggccccagaagtcaacgaataataaccactccgagcgccgacttgtctcgcacagtaatagacggcgtgtcgtcgcctctcaggttgttcatttgaagataaaccgtgttcctggaattgtccctggagatggtgaatcggcccttcacggagtctggcgtagtatgtggaaatcaccagtataaatgactgagacccactccagccccttccctggagcctggcggacccaactcatgtagttgctggtgacggtgagcccagaggctgcacaggagagtctctgggaccccccccaggctggactaagcctcctccagactccatcagccgcacctcacactggacaccttttaaaagtccaacaaggagaacccagctcagcaaaactccatggtgagtcctctgtgttcagtgctgatcacccgaatggaaacacctcggaatcccagtgctgggctcctctcgcccccaaacccaacgtgcgagtgctaaatcgagcaccggtcgtgtatatactgtctgatggcgcgagggaggcgatacg

SEQ ID NO: 794134 - DNA, 716 bp, Homo sapiens
  misc_feature: 76382.UNK.UNK.UNK.pb.heavy.1.raw 76382
cgatatcgcctccctcgcgccattcagacagtatatacacgcccgaccggtgctcgatttagctgcgtcacgatctctcttgggagctctgagagcggagccccagccccagaattcccaggtgttttcatttgtgatcagcactgaacacagaggactcaccatggagttcgggctgagctgggttttccttgttgttattttacaagggtgtccagagtgaagtgcagttggtggagtccgggggagacttggtccagcctggaggtccctgagactctcctgtgtcgcctctggatttcaccatcagtgaccactatatggactgggtccgccaggctccagggaaggggctggagtgggcttggccgcagtaaaaacaaagttgcccagccttatcacagagtacgccgcgtctgtgaaagccagattcaccctctctcaagagatgacttcaagaactcattgattctgcgaatgactaacctgaaaaaccgaggacacgggcatgtattattggtgttgtgtttatatcaggaactgtccactggggccaggggaaaccctggtcaccgtctcctcagcctccaccaagggcccatcggtcttcccctggcgccctgctccaggagcacctccgagagcacagcggccctgggctgcctggtcaaggactacttcctatatactgtctgagcggctggcaaggcgcatag

SEQ ID NO: 794135 - DNA, 698 bp, Homo sapiens
  misc_feature: 76390.44.56.F01.1.pb.heavy.1.raw 76390
ctatgcgccttgccagcccgctcagacagtatataggaagtagtccttgaccaggcagccagggccgctgtgccccagaggtgctcctggagcagggcgccaggggaagaccgatgggcccttggtggaagctgaagagacggtgaccattgtcccctggccccaaatatcaaatgcatcgacgtcccagatcgcctggcgcagtaatagacgcctgtgtcgtcgggtctcaggttgctcatttgtaaatggccaacactgttggagtcatcccttgagacggtgaatcttccttcacagacgcggcgtactctttacttccaccataacgtttcattctgacgaaagtgatccactcaagcccttccctggagcctgacggacccaggccaagtgataatcactaagactgaatcctgagactacacaggagagtctcagagaccgccctggctgtgccaagcccccccgactccgccagtcgccctcgcactggacaccttctaaaaaactacaaggaaaatcaagattagcccaaactccatggttggtggtctgtgctcagtgctgatcaccaagtggaaactcctgggaatctcacggctggggctcctctccagccctttgtgtgttcagacgtctgctaaatcgagcaccggtcgtgtatatactgtctgatggcgcgaggaggcgatacg

SEQ ID NO: 794136 - DNA, 606 bp, Homo sapiens
  misc_feature: 76396.UNK.UNK.UNK.pb.heavy.1.raw 76396
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794137 - DNA, 711 bp, Homo sapiens
  misc_feature: 76398.UNK.UNK.UNK.pb.heavy.1.raw 76398
cgtatcgcctccctcgcgccatcagacagtataacacgaccggttgctcgatttagctgcgtcacgatctctcttggggagctctgagagcggagccccagccccagaattccccaggtgtttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggcctggagtggcttggccgcagtaaaaacaaagttgccagctttatcacagagtacgccgcgtctgtgaaagccagattcaccctctcaagagatgacttcaagaactcattgattctgcgaatgactacctgaaaaccgaggacacgggcatgtattattgtgttgtgtttatatcaggaactgtccactggggccagggaaccctggtcaccgtctcctcagcctccaccaagggcccatcggtcttcccccctggcgccctgctccaggagcacctccgagagcacagcggccctgggcttgccctgggtcaaggactacttcctatatactgtctgagcgggctggcaaggcgcatag

SEQ ID NO: 794138 - DNA, 707 bp, Homo sapiens
  misc_feature: 76406.UNK.UNK.UNK.pb.heavy.1.raw 76406
cgtacgcctccctcggcgccaatcagacagtatatacacgaccggtgctcgatttagcactccgccacgttgggtttggggagaggagcccagcactgggattccgagggtttccattcggtgatcagcactgaaacacagaggactcaccatggagtttttggctgagctgggttcccttgttggacttttaaaaggtgttccagtgtgaggtggcggctgatggagtctggaggaggcttagtccagcctggggggtcccagagactctcctgtgcagcctctgggctcaccgtcagcagcaactacatgagttgggtccgccaggctccagggaaggggctggagtggtctccagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaagggcccatcggtcttccccctggcaccctcctccaagagcacctctggggcacagcggccctggggctgcctggtcaaggactacttcctatatactgtctgagcgggctggcaaggcgcatag

SEQ ID NO: 794139 - DNA, 708 bp, Homo sapiens
  misc_feature: 76446.44.45.E01.1.pb.heavy.1.raw 76446
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtggaccagggctcccctggccccagttagaaacgatgggcttcgtacaataatagagagccgagtcctcggctctcaaattgttcatttgttagatacacggtggtttcttggaaattgtctctggagaacggagaaatcgggcccttcacggagtttccatagtattcttttacttccatcagaccagatgactgccacccactccagccccttgcctggagcctggcggaacccagtgcatggcagagtcactgaaactgagtccggaccgcaacacaggagagtctcagggacgtccccaggctggaccacgcctcccccagactccaccagctgaacctgaccactggacacctcttaaaagagcaacgaggaaaaaccccagctcagcccaaactccatggtgagtcctctgtgttcagtgctgatcaccgaatggaaacacccgccgacttctagtgctgggctcctctcccagccccctttcccttactgactcactaaaatcgagcaccggtcgtgttatatactgtctgatgggcgcgagggagggcgatacg

SEQ ID NO: 794140 - DNA, 601 bp, Homo sapiens
  misc_feature: 76450.UNK.UNK.UNK.pb.heavy.1.raw 76450
aggctgggcaggctatgcaccctggtccagtcaaagctgcggaacccgctagcggccatctggccactaggggtcccgcagattcatattgtcggtctagcatgcacaatgctgcaaacccagcttgcatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaaataaaagtaaactcaacaccccaagcaggctatggggggtgatagggtggattctatttcctatcccatcccctaggatctcaattagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgaactgtcttaaaggcaatatgtcgtcccttagctccaagtcctagcaagcgtgtcggg

SEQ ID NO: 794141 - DNA, 708 bp, Homo sapiens
  misc_feature: 76471.44.56.F01.1.pb.heavy.1.raw 76471
ctatgcgccttgccagcccgctcagacagtatataggaagtagtccttgaccaggcagcccagggccgctgtgccccagaggtgctctggagcagggcgccaggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcgcgtactctttacttccaccataacgtttcattctgacgaaagtgatccactcaagcccttcctggagcctgacggacccaggccaagtgataatcactaagactgaatcctgagactacacaggagagtctcagagaccgccctggctgtgccaagccccccccgactccgccagtcgccctcgcactggacaccttctaaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 794142 - DNA, 719 bp, Homo sapiens
  misc_feature: 76475.44.67.G01.1.pb.heavy.1.raw 76475
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagcccccttccctggagcctggcggaccaactcatgtagttgctgctgacggtgagccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccccaaacccaatatgtatactctaatcgagcaccggtcgtgtatatactggtctgatggcgcgagggaggcgatacgctgtcagtctctc

SEQ ID NO: 794143 - DNA, 592 bp, Homo sapiens
  misc_feature: 76482.44.78.H01.1.pb.heavy.1.raw 76482
ctatgcgccttgccagcccgctcagacagtatataggaagtagtccttgaccaggcagcccagggccgctgtgctctcggaggtgctcctggagcagggcgccagggggaagaccgatgggccccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttcccccaaacccaaactactcacactaaatcgagcaccggtcgtgtatatactgtctgatggcgcgagggaggcgatacg

SEQ ID NO: 794144 - DNA, 699 bp, Homo sapiens
  misc_feature: 76498.UNK.UNK.UNK.pb.heavy.1.raw 76498
ctatgcgccttgccagcccgctcagacagtataggaggtagtccttgacccaggcagccaggccgctgtgcctcggaggtgctcctgggcagggcgccaggggagaccgatgggcccttggtggaggctgaggagacggtgaccagggttccctggccccagtgggacagtttcctgaataaacacaacacaataaatacatggcccgtgtcctcggttttcaggttagtcattcgcagaatcaatgaggttccttgaagtcatctcttgagagggtgatctggctttcacagacgcggcgtactctgtgataaagctggcaactttgtttttactgcggccaagccactccagcccccttccctggagcctggcggaccccagtccatatagtggtcactggatggtgaatccagaggcgaaccagggagagtctcagggacccctccaggctggaccaagtctcccccggactccaccaactgcacttcacctggacaccttgaaaaataacaaacaaggaaaacccagctcagcccgaaactccatggtgagtcctctgtgttcagtgctgatcaccaatgaaaacacctggaattctggggctgggctccgcctcccccaagagagatcgtgacgcgctaaaatcgagcaccggtcgtgtatatactgttctgatggcgcgagggaggcgatacg

SEQ ID NO: 794145 - DNA, 679 bp, Homo sapiens
  misc_feature: 76502.44.35.D02.1.pb.heavy.1.raw 76502
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgaggggcggggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatcccaaacccaacctatcgtgtgctaaatcgagcaccggtcgtgtatatactgtctgatggcgcgaggaggcgataacg

SEQ ID NO: 794146 - DNA, 697 bp, Homo sapiens
  misc_feature: 76532.44.55.E11.1.pb.heavy.1.raw 76532
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtccagagactctcctgtgcagcctctgggctcacgtcagcagcaactacatgagttgggtccaccaggctccaggaaggggctggagtggtctcagtcatttatactggtgatttcacatactacgcagactccgtgaagggccgattcaccatctccagggacaattccagaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggcccggctgcctggtcaaggactacttcctatatactgtctgagcgggctggcaaggcgcatag

SEQ ID NO: 794147 - DNA, 617 bp, Homo sapiens
  misc_feature: 76544.44.23.C01.1.pb.heavy.1.raw 76544
ctatgcgccttgccagcccgctcagacagtatataggaagtagtccttgaccaggcagcccagggcgctgtgcccccagaggtgctcctggagcagggcgccaggggaagaccgatgggcccttggtggaagctgaggagacagtgaccaggggtgccacggccccatagattgaaagaccagtctcgcctcgcacagaaataaacggccgtgtccgcggcggtcacggaggtcagtttcagggagaagcggttcatggacgtgtcctcgaaatggtgagacgactcttgagggacggagagtaagtacgtcgccccagtataatggatgtcaccaatccactccattcccctccctggggctggccggatccagccccaagaatgatcagaactgatggaaactccagagacagtgcaatgaagacagggttcccgaaggcctcaccagtcctgggcccgactcctgcagctgcacctgggacaggacccatctgggagctgccaccagcaggaggaaaaaccacaggtgttcaccctgcccaatccctaatcacgtgtactaaatcgagcaccggtcgtgtatatactgtctgatggcgcgagggaggcgatacg

SEQ ID NO: 794148 - DNA, 692 bp, Homo sapiens
  misc_feature: 76561.44.73.G07.1.pb.heavy.1.raw 76561
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggccccagtagtcaagcggggaccgtctcgaggggctctcgcacaataatagacagccgtgtcctcacttgtgaggttgtacatttgcagatgcagtgtgttcctggaattgtctctggagacggtgaatcggccccttctcggagtctccgtagtgttcttcaattccatcttctgatataattgccacccactccagccccttgcctggagcctggcggacccagtgcatggcataggtcctgaagatgaatccagaggctgcacaggagagtctcagggagttcccaggctgggccgctcctcccccagactccactagctgcacctgacactggccacctcttaaaagagcaacgaggaaaaccatctcagcccaaagtccatggtgagtcctctgtgttcagtgatgatcaccgaatggaaacaccggcgacttccagtgctgggctcgtctcccccccctgagcgtagagctaaatcgagcaccggtcgtggtatatactgtctgatggcgcgaggaggcgatacg

SEQ ID NO: 794149 - DNA, 651 bp, Homo sapiens
  misc_feature: 76574.44.53.E09.1.pb.heavy.1.raw 76574
cgtatcgcctccctcgcgcgccatcagacagtattacacgaccggtgctcgattagagagagtgtgtttggttggggggaagcacctgtggttcttcctcctgctgtggcgctcccagatgggtcctgtctcagccgcagctgcggagtcggcccagactggtgaagccttcgagaccctgtccctccacgtgcacggtctctggtgcctcatcgacagaataatttctactggggctggatccgcccagcccccaggagaggggctgcagtggattggagtctctattatagtgggaacacctactacaaccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctggggcaagggaccacacggtcaccgtctcctcatcctcagcctccaccaacggcccatcgtcttcgcccctggcgcccctgctccaggagcacctccggagagcacagcgccctgggctgcctggtcaaggactacttcctattactggtctgagcgggctggcaaagcgcgcatag

SEQ ID NO: 794150 - DNA, 701 bp, Homo sapiens
  misc_feature: 76586.44.55.E11.1.pb.heavy.1.raw 76586
cgtatcgcctccctcgcgccatcagacagtatatacacgaccggtgctcgatttagcactcgcacgttgggtttggggagaggagccagcactgggattccgaggtgtttcattcgggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtggggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794151 - DNA, 617 bp, Homo sapiens
  misc_feature: 76593.UNK.UNK.UNK.pb.heavy.1.raw 76593
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggcgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagcccaagaatgatcagaactgatggaaactccagagacagtgcagatgagagacagggttcccgaaggcctcaccagtcctgggcccgactcctgcagctgcacctgggacaggacccatctggagctgccaccagcaggaggaacaaaccacagtgttcaccctgcccccaatcctaattcacgtgtactaaatcggcaccggtcgtgtatatactgtctgatggcgcgagggaggcgatacg

SEQ ID NO: 794152 - DNA, 705 bp, Homo sapiens
  misc_feature: 76602.44.55.E11.1.pb.heavy.1.raw 76602
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794153 - DNA, 697 bp, Homo sapiens
  misc_feature: 76623.UNK.UNK.UNK.pb.heavy.1.raw 76623
cgtatcgcctccctcgcgccatcagtctatactatcacgacggtgctcgatttagctgcgtcacgatctctcttgggggagagcggagccccagccccagaattcccaggtgttttcatttgggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagcttttatcacagagtacgccgcgtctgtgaaagccagattcaccctctcaagagatgacttcaagaactcattgattctgcgaatgactaactgaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctgcaaggcgcatag

SEQ ID NO: 794154 - DNA, 747 bp, Homo sapiens
  misc_feature: 76629.44.33.C11.1.pb.heavy.1.raw 76629
ctatgcgccttgccagcccgctcagacagtataataaggaattagatagtccttgaccaggcagcccagggccgctgtgcccccagaggtgctcttggaggagggtgccagggggaagaccgatgggcccttggtgggaggctgaggagacggcgaccgtggtcccttggccccaggcgtccataccattggagtagagcatgtcatatctgtatccacgagcccccatctctcgcacagtagtagacagccgtgtcctcggcttctcaggctattcatttccagatatagtgtgttcttcgaattgtctctggagatggtgaatcggcccttcacggaatctacataatatttattacttccatcataccatataagtgccacccactccagtccttgcctggaggcctggcggacccagtgcatgccatgtctgttgaaggtgaatccagacgctacacaggagagtctcagggacctcccaggctggaccacggcctccccagactccaccagcttcacctgacactggacacctcttaaaagagcaacgaggaaaacccaggtcagcccaaactccatggtgagtcctctgtgttcggtgctgatcaccgactggaaacaccggccgaagcccttctggtgctgggctgccgctctcccagagctccccaaacccaacgagctcactctaaatcgagcaccggtcgtgtatatactgtctgatggcgcgagggaggcgatacg

SEQ ID NO: 794155 - DNA, 733 bp, Homo sapiens
  misc_feature: 76633.UNK.UNK.UNK.pb.heavy.1.raw 76633
ctatgcgccttgccagcccgctcagacagtatataggaagtagtcctttgaccaggcagcccaggccgctgtgcttcggaggtgctccctggagcagggcgccaagggggaagaccgatgggcccttggtggaggctgaggagaccggtgaccagggttccccggccccagtagtcaaaaccagcactgaccaagtggcccgatctctcgaacagaagtagacagccgtgtcctcgtctctccaggctgttcatttccagatacagtgagttcttggcattgtccctggaattggtgaatcggccttcacagagtctgcgtagtaggtggtatctccagcaatattaacatatgaaacccactccagcccccttccctggagccctggcggacccagttcatcggcatagtcacttgaagatgaatccagaggctgcacaggagagtctcagggaccccccccccgctgtaccaaagcccctccccccagactccaccagcgcacctccacagtggacaccttctaaaatagcaacaaggaaaaacccagcgcagccccaactccatggtgagtcctcttgtgtttcattgctgattcacaccaagtgggaaattgccttggaatccagggctaaggcacctctctgagagctcccaaggagatcgtaggacgcagctaaatcgagcaccggtcgtgtatatactgtctgaatggcgcgagggaggcgatacg

SEQ ID NO: 794156 - DNA, 716 bp, Homo sapiens
  misc_feature: 76635.UNK.UNK.UNK.pb.heavy.1.raw 76635
cgtatcgcctccctcgcgccatcagacagtatatacacgaccggtgctcgatttagctgcgtccacgatctctcttgggggagagcggagccccagcccagaattcccaggtgttttcatttggtgaatcagcactgaacacagaggactcaccatggagttcgggctgagctgggttttccttgttgttattttacaaggtgtccagagtgaagttgcagttggtggagtccgggggagacttgggtccagcctggaggtcccctgagactctcctgtggtccgcctctggattcaccatcagtgaccactatatggactgcgtcccggcccagggctccagggaaggggctggagtggcttggccgcagtaaaaacaaagttgccagctttatcacaggagtacgccgcgtctgtgaaagccagattcaccctctcaagagatgacttcaagaactcattgattctgcgaatgactaacctgaaaaccgagggacacgggcatgtattattgtgtttgtgttttatatcaggaactgtccactggggccagggaaccctggttcaccgtctctcagcctccaccaagggcccatcggtctttccccctggcgccctgctccaggagcacctccgagagccacagcgggcccctgggctgcctggttcaggactacttcctatatactgtctgagcgggctggcaaggcgcatag

SEQ ID NO: 794157 - DNA, 680 bp, Homo sapiens
  misc_feature: 76636.UNK.UNK.UNK.pb.heavy.1.raw 76636
cgtatcgcctcctcgcgccatcagacagtatatacacgaccggtgcctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaaggccgattctccgtctccagagacaattccaagaacaccgtgtatctacaaatgaacaatttgagagccgaggactccggctctctattattgtacgagcccatcgttctactggggccagggagccctggtcaccgtctcctcagcctccaccagggcccatcggtcttccccctggcgccctgctccaggagcacctccgagagcacagcggccctgggctgcctggtcaaggactacttcctatatactgtctgagcgggctggcaggcgcatag

SEQ ID NO: 794158 - DNA, 642 bp, Homo sapiens
  misc_feature: 76639.44.86.H09.1.pb.heavy.1.raw 76639
ctatgcgccttgccagcccgctcagacagtatataggaagtagtccttgaccaggcagcccagggccgctgtgcccccagaggtgctcctggagcagggcgccagggggagaccgatgggcccttggtgaagctgaggagacagtgaccagggtgccacggccccatagattgaaagaccagtctcgcctcgcacagaaataaacggccgtgtcgcggcggtcacggaggtcagtttcaggagaagcggttcatggacgtgtccctcgaaatggtgagacgactcttgagggacggagagtagtacgtcgccccagtataatggatgtcaccaatccactccattcccctccctgggctgccggatccagcccaagaatgatcagaactgatggaactccagagacagtgcagatgagagacaggttcccgaaggcctcaccagtcctggccgactcctgcagctgcacctgggacaggacccatctgggagctgccaccagcaggaggaaaaccacaggtgcttcatgttcttgcacaggagtccttgactctcagaaagcatcccaaacccaagtctatagcactaaaatcgagcaccggtcgtgtatatactgtctgatggcgcgagggaggcgatacg

SEQ ID NO: 794159 - DNA, 703 bp, Homo sapiens
  misc_feature: 76646.44.27.C05.1.pb.heavy.1.raw 76646
cgtatcgcctccctcgcgccatcagacagtatatacacgaccggtgctcgatttagacgcgatcgaaggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794160 - DNA, 726 bp, Homo sapiens
  misc_feature: 76649.44.62.F07.1.pb.heavy.1.raw 76649
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagaccggtcaccactgtccccaggccccaagtactaaaggtgtcatggggggtcaccgtggtcctggctttcaaacagtaatagacgcctgtgtcctcggtctcaggtttttcatttggagaaacaatttgtcctgcgaattggtccctggaaatggtgaagcggcccttcacggagtctccgtagaaagtgacaccaccagcttccgatacttgagacccactccagtcccctccccctggagcccggccggacccaggtcatgccataggccactaaaggtgaatccagaggccgcacaggagagggtcagggacctcccaggccgaatcaggcccccccccagactccaacaactgcacttcacacacgacaccctttaaaaagcccacagaaaaaaggcagctcagcccaaactccatggagactgtctctctgttcggtcctgggtcaccaaatgaagacacctgaaaaatcccagggctgggctcctctctcagagctccccttttccctttttatgcgactactaaatcgagcaccggtcgtgtatatactgtctgatggcgcgagggaggccgatacg

SEQ ID NO: 794161 - DNA, 698 bp, Homo sapiens
  misc_feature: 76653.44.27.C05.1.pb.heavy.1.raw 76653
cgtatcgcctccctcgcgccatcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctccaccaagggcccatcggtcttccccctggcgccctgctccaggagcacctccgagagcacagcggccctggctgcctggtcaaggactacttcctatatactgtctgagcggctggcaaggcgcatag

SEQ ID NO: 794162 - DNA, 685 bp, Homo sapiens
  misc_feature: 76660.44.45.E01.1.pb.heavy.1.raw 76660
cgtatcgcctccctcgcgccatcagacagtatataacacgaccggtgctcgatttagtgagtcagtaagggaaaggggctgggagaggagcccagcactagaagtcggcggtgtttccattcggtgatcagcactgaacacagaggactcaccatggaagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtggtggcagtcatctggtctgatggaagtaaagaatactatggaaactccgtgaagggcgattctccgtctccagagacaattccaaagaacaccgtgtatctacaaatgaacaatttgagagccgaggactcggctctctattattgtacgagccatcgttctactggggccagggagccctggtcaccgtctcctcagcctccaccaaagggcccatcggtcttccccctggcgccctgctccaggagcacctccgagagcacagcggccctgggctgcctggtcaaggactacttcctatatactgtctgaagcgggctggcaaggcgcatag

SEQ ID NO: 794163 - DNA, 623 bp, Homo sapiens
  misc_feature: 76666.UNK.UNK.UNK.pb.heavy.1.raw 76666
gaaggctgggcagggctatgcacccctggtccaggtcaaaagctgcggaacccgctagcggccatcttggccactaggggtcccgcagattcatattgtcgtctagcatgcacaatgctgcaaaacccagcttgcaatgcccacagcaaggcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggcgggtgataggggtggattctatttcctatcgccgcatcccctaggatctcaattaagttactagcgagttaaatgtctgtagcgatcccgtcagtcctatcgcgcgcatcaagacctggttggttgagcgtgcagtagatcatcgataagctgcgagttagggtcatcccagaccgcatctgcgcgcctaaacgttcagtggtagctaaggcgtcaccttcgactgtctaaaggcaatatgtcgtccttagctccaagtccctagcaagccgtgtcgggtc

SEQ ID NO: 794164 - DNA, 686 bp, Homo sapiens
  misc_feature: 76667.44.21.B10.1.pb.heavy.1.raw 76667
ctattgcgccttgccagcccgctcagacagtatataggaagtagtccttgaccaggcagccagggccgctgtgctctcggaggtgctcctggagcagggcgccagggggaaagaccgatgggcccttggtggaggctgaggagacggtgaccagggttccctggccccagtggacagttcctgatataaacacaacacaataatacatgccgtgtcctcggtttcaggttagtcattcgcagaatcaatgagttcttgaagtcatctcttgagagggtgaatctggctttcacagacgcggcgtactctgtgataaagctggcaactttgttttactgcggccaagccactccagccccttccctggagcctggcggaccagtccatatagtggtcactgatggtgaatccagaggcgacacaggagagtctcagggaccctccaggctggaccaagtctcccccgactccaccaactgcactttcactctggacaccttgtaaaataacacaaggaaaacccagctcagcccgaactccatggtgagtcctctgtgttcagtgctgatcaccaaatgaaaacacctgggaattctggggctggggctccgctctctcttgcgacgacactaaatcgagcaccggtcgtgtatatactgtctgatggcgccgagggaggcgatacg

SEQ ID NO: 794165 - DNA, 715 bp, Homo sapiens
  misc_feature: 76679.44.86.H09.1.pb.heavy.1.raw 76679
ctatgcgccttgcagccgctcagacagtatataggaagtagtccttgaccaggcagccagggccgctgtgcccccagaggtgctcttggaggagggtgccaggggaagaccgatgggcccttggtggagctgaggagacggcgacccgtggtccttggcccaggcgtccataccattggagtagagcatgtcatatctgtatcacgagccccatctctcgcacagtagtagacagccgttgtcctcggctctcaggctattcatttccagatataggtgtgttcttcgaattgtctctggagatggtgaatcgcccttcacggaatctacataatatttattacttccatcataccatataagtgccaccccacctcagtcccttgcctggagcctggcggacccagtgcatgccatgtctgttgaaggtgaatccagacgctacacaggaagtctcagggacctcccaggctgaccacgcctcccagactccaccagcttcacctgacactggacacctcttaaaagagcaacgaggaaaaccaggtcagcccaaactccatggtgagtcctctgtgttcgtgctgatcaccgactggaaacaccgccgacttctggtgctggctcctctcccagagctcccaacccaagtctatagcactaaatcgagcaccggtcgtgtatatactgtctgatggcgcgaggaggcgatacg

SEQ ID NO: 794166 - DNA, 723 bp, Homo sapiens
  misc_feature: 76687.UNK.UNK.UNK.pb.heavy.1.raw 76687
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccgtggtccttggccccagacggtccataccgtagtagtagtcccagcaggtggtagtactacaatatgtcctcgcacagtaatacacagccgtgtcctcggctctcaggctgttcatttgcagatacagcgtgttcttggaattgtctctggagatggtgaatcggcccttcacggagtctgcatagtatttattacttccatcataccatataagtgccacccactccagccctttgcctggagcctggcggacccagtgcatgccataggtactgaaggtgaatccagacgctgcacaggagagtctcagggacctcccaggctgaccacgccttccccagactccaccagctgcacctgacactggacaacctcttaaaagagcaacgaggaaaacccagctcagcccaaactccatggtgagtcctctgtgttcagtgctgatcaccgaatggaaacaccgccgacttctagtgctgggctcctctcccagagctccccgcgactgagtgatactaaatcgagcaccgtcgtgtatatactgtctgatgggcgcgagggaggcgatacg

SEQ ID NO: 794167 - DNA, 713 bp, Homo sapiens
  misc_feature: 76692.UNK.UNK.UNK.pb.heavy.1.raw 76692
ctatgcgccttgccagcccccgctcagacagtatataggaagtagtccttgaccaggcagcccagggccgctgtgcccccagaggtgctcttggaggagggtgccagggggaagaccgatgggcccttggtggaggcggaggcgacggtggaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggtcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacacctcggacacctttaaaagtccaacaaggagacccagctcagccaaaactccatggtgagtcctcctgtgttcagtgctgatcaccgaatggaaacacctccgaatcccagtgctgggctcctctcccccccaaaccccaaacgtgcgagtgctaaatcgagcactggtcgtgtatatacctgtctgatggcgcgagggaggcgatacg

SEQ ID NO: 794168 - DNA, 742 bp, Homo sapiens
  misc_feature: 76693.44.85.H08.1.pb.heavy.1.raw 76693
cgtatcgcctccctcgcgccatcagacagtatatacacgaccggtgctcgatttagtatcactcagtcgcgggagctctgggagaggagcccagcactagaagtcggcggtgtttccattcggtgatcagcactgacacagaggactcaccatggagtttgggctgagctgggtttttcctcgttgctcttttaagaggtgtccagtgtcaggtggcagctggtggagtctgggggaggcgtggtccagcctggggaggtccctgagactctcctgtgcagcgtctggattcaccttcagttacctatggcatgcactgggtccgccaggctccaggcaaggggctggagtggggtggcacttatatggtatgatggaaagtaataaatactatgcagactccgtgaagggccgattccaccatctccagagacatattccaagaacacgctgtatctgcaaaatgacagcctgagagccgaggacacggcttgtgtattactgtgcgagggacatattgtagtactaagccacctgctgggacctactactgacggtatggacgtctggggccaagggaaccacggtcaccgtctcctcagccctccaccaaggggcccatcggtcttccccctggcacccctcctccaagagcacctctggggcacagcgggccctgggctgcctggtcaagggactactgtcctattatactgtctgagcgggctggcaaggcgcatag

SEQ ID NO: 794169 - DNA, 616 bp, Homo sapiens
  misc_feature: 76698.UNK.UNK.UNK.pb.heavy.1.raw 76698
acccgacacgcttgctagggacttggagctaaggacgacatattgcctttagacagtcgaaaggtgacgccttagctaccactgaacgtttaggcgccagatgcggtctgggatgacctaactcgcagcttatcgatgatctactgcacgctcaaccaaccaggtctttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttcccgggaagtggagtaatgggtttgtctacttccccctaaaccgcaaagtactagttttacgagtggcgttgcaagccatagccagtcacaggtaataaacaattcaacgtggcgtaaagattggccgcttgctgtgggcattgcaagctgggttttgcagcattgtgcatgctagacgacaatatgaatctgcgggacccctagtggccaagatggccgctagcgggttccgcagcttttgacctggaccagggtgcatagccctgcccagccttc

SEQ ID NO: 794170 - DNA, 731 bp, Homo sapiens
  misc_feature: 76699.44.33.C11.1.pb.heavy.1.raw 76699
ctatgcgccttgccagcccgctcagacagtatataggaagtagtccttgaccaggcagcccagggccgctgtgcccccagaggtgctcttggaggagggtgccagggggaagaccgatgggccccttggtggaggctgaggagacggcgaccgtggtcccttggcccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaacccaacgagctcactctaaatcgagcaccggtcgtgtataatactgtctgatggcgcgagggaggcgatacg

SEQ ID NO: 794171 - DNA, 672 bp, Homo sapiens
  misc_feature: 76728.UNK.UNK.UNK.pb.heavy.1.raw 76728
cgtatcgcctccctcgcgcatcagacagtatatacacgaccggttgctcgattagatctactgacaaccacattcctcctctaaagaagcccctgggagcacagctcatcaccatggactggacctggaggttcctctttgtgtggcagcagcaacaggtgtccagtccctggtgcaactggtgcagtctgggactagaatgccgcaaccttggtcctcggtgaccctttcctgcacggcctctggaagtactaccagttccactacttataccatcaactggggttgtgccaggccctggacaagggcttgaagtggatgggtggaatcatccctcttttttgctcactcacctacgcacgagacttccgggccagaattacgattaccggcggacaagtccacagacacagtctccatgacaatgagttctttgaatccggacgacacggcgcgtctactactgtgcgagaggtccgtaccccagctcgcatggagcctttgagatctgggggcagggaaccctggtcattgtcacctcagcttccacaagggccatcggtcttcccctggcgccctggctccaggagcacctctggggcacagcggccctgggctgcctggtcaagactacttctatatactgtctgagcgggctggcaaggcgcatag

SEQ ID NO: 794172 - DNA, 686 bp, Homo sapiens
  misc_feature: 76752.UNK.UNK.UNK.pb.heavy.1.raw 76752
cgtatcgcctcccgcgcggcatcagacagtatatacacgaccgtgctcgatttagagtgagctcgttgggttttgggagctctgggagaggagcccagcaccagaagtcggcggtgtttccagtcggtgatcagcaccgaacacagaggactcaccatggagtttgggctgacctggtttcctcgttgctctttaagaggtgtccagtgtcagtgaagcggtggagtctggggaggcgtggtccagcctggaggtccctgaaactctcctgtgtagcgtctggattcaccttcaacagacatggcatgcactggtcgccaggctccaggcaagggatgggtgggtggcactttatggtatgatggaagtaataatattatgtagttccgtgaaggccgattcaccatctccagagacaattcgaagaacacactatatctgaatgaatagcctgagagccgaggacacgggtctactactgtgcgagagatggggctcgtggatacagaatgacatgcttactcatggtatggacgcctgggcaaggagccagtcgccgtcctcagcctccaaggcatccgtctcccggcaccctctccaagagcacctctgggggcacagcggccctggctgcctggtcaaggactacttccatatactgtctgacgggctggcaaggcgcatag

SEQ ID NO: 794173 - DNA, 714 bp, Homo sapiens
  misc_feature: 76756.44.33.C11.1.pb.heavy.1.raw 76756
ctatgcgccttgccagcccgctcagacagtatataggaagtagtccttgaccaggcagccagggccgctgtgcccccagagtgctcttggaggagggtgccagggggaagaccgatggcccttggtggaggctgaggagacggcgaccgtggtcccttggcccaggcgtccatacattgagtagagcatgtcatatctgtatccacgagcccatctctcgcacagtagtagacagcgtgtctcggctctcaggctattcatttccagatatagtgtgttcttcgaattgtctctggagatggtgaatcggcccttcacggaatctacataatatttattacttccatcataccatataagtgccaccactccagtccttgcctggagcctggcggacccagtgcatgccatgtctgttgaaggtgaatccagacgctacacaggagagtctcaggacctcccaggctggaccacgctcccccagactccaccagcttcacctgacactggacacctcttaaagagcaacgaggaaaacccaggtcagcccaaactccatggtgagtcctctgtgttcggtgctgatcacgactggaaacaccgccgacttctggtgctgggctcctctcccagagctcccaaacccaacgagctcactctaaatcgagcaccggtcgtgtatatactgtctgatggcgcgagggaggcgatacg

SEQ ID NO: 794174 - DNA, 714 bp, Homo sapiens
  misc_feature: 76794.44.56.F01.1.pb.heavy.1.raw 76794
cgtatcgcctccctcgcgccatcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcactctgggggcacagcggccctgggctgcctggtcaaggactacttcctatatactgtctgagcgggctggcaaggcgcatag

SEQ ID NO: 794175 - DNA, 606 bp, Homo sapiens
  misc_feature: 76801.UNK.UNK.UNK.pb.heavy.1.raw 76801
aggctggggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaacccattactccacttcccggaagttcaactcattccaacacgaaataaaagtaaactcaacaccccaagcaggctatgtggggggggtgataggggtggattctatttcctatccatcccctaggatctcaattaagttactagcgagttaaatgtctgtagcggatcccgtcagtcctatcgcgccgcatcaagacctggtggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794176 - DNA, 717 bp, Homo sapiens
  misc_feature: 76826.UNK.UNK.UNK.pb.heavy.1.raw 76826
ctatgcgccttgccaggccccgctcagacagtatataggaagtagtccttgaccaggcagcccagggccgcctgtgctctcggaggtgctcctggagcagggcgccagggggaagaccgatgggcccttggtggaggctgaggagacggtgaccagggttcccctggccccagtggaccagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgttttttactgcggccaagccactccagcccccttccctggagcctggcggaccccagtccatatagtggtcactgatggtgaatccagaggcgacacaggagagtctcagggaccctccaggctggaccaagtctcccccggactccaccactgccacttcactctggacaccttgtaaaataacaacaaggaaaaccccagctcagcccgaactccatggtgagtcctctgtgtttcagtggctgatcaccaaatgaaaacacctggaattctggggctggggctccgctctcagagctccccaagagagatcgtgacgcagctaaatcgagcaccgggtcgtgtatatactgtctgatggcgcgagggaggccgatacg

SEQ ID NO: 794177 - DNA, 714 bp, Homo sapiens
  misc_feature: 76837.UNK.UNK.UNK.pb.heavy.1.raw 76837
ctatgcgccttgccagcccgctcagacagtatataggaagtagtccttgaccaggcagcccagggccgctgtgctctcggaggtgctcctggagcagggcgccagggggaagaccgatgggcccttgtggaggctgaagagacggtcaccactgtcccccggcccccaagtactaaaaggtgtcatggggggtcaccgtggtcctggctttccaaaccagtaaatagacgcctgtgtcctccgggtctcaggtttttccatttggagaaacaatttgtcctgccgaattgtccctggaaatggtgaagcggccccttcacggagtctccgtagaaagtgacacccaccagctcgatacttgagacccactccagtcctccctggagcccggcggacccaggtcatgccataggcactaaaggtgaatcagaggccgcacaggagagggtcagggacctcccaggccgaatcaggccccccccagactccaacaactgcacttcacacacgacacctttaaaaaagccacaagaaaaaggcagctcagcccaaactccatgagacttctctctgttcggtcctggtcaccaaatgaagacacctgaaaatcccagggctgggctccctctcagagctccctttccctttatgcgactactaaatcgagcacccggtcgtgtatatactgtctgatggcgcgagggaggcgatacg

SEQ ID NO: 794178 - DNA, 750 bp, Homo sapiens
  misc_feature: 76842.UNK.UNK.UNK.pb.heavy.1.raw 76842
cgtatcgcctcccctcgcgccatcagacagtatatacacgaccggtggctcgatttagacgcgatcgaagggtttggggggctgggagacgagcccagcactggaagtcgccggtgtttccactcggtgatcatcactgaaacacagaggactccaccatggagttttgggctgaagctgggttttcctcgttgccctcttaagagggtgtcatgtgtcaggtgcaattcgttggagttcctggggggaggcgtggccccagtaggggggtccctggagacttccctgttgcagcctctggattcaccttcgataattggaatatgcagtggggtccccgccaggctcccaggcgagggctggagtgggttggcaggtgtgtcatttcatggaggaaatcaagtctacggtggattccggttgagggccgattccaccatctccagagacaattccgagaacacagtgtctcttcaaatgaacagccctgaggaccttcaggacacggccggtgtatttttgtgcgagactatctgtttccaaaaattcggttcattcgaccccggcccggggtgccagggaaccccctggtcaccgtctcctcgggcctcccaccaaagggcccatcggtcttccccctggcgcccctgctccaggagccacctccgagagcacagcggccctggggctgcctggtcaaggaactactttcctataatactgtctgagcgggctggcaaggcggcatag

SEQ ID NO: 794179 - DNA, 707 bp, Homo sapiens
  misc_feature: 76852.44.55.E11.1.pb.heavy.1.raw 76852
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacgggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaatcgagcaccggtcgtgtatatactgtctgatggcgcgagggaggcgatacg

SEQ ID NO: 794180 - DNA, 641 bp, Homo sapiens
  misc_feature: 76856.UNK.UNK.UNK.pb.heavy.1.raw 76856
ctatgcgccttgccagcccgctcagacagtatataggaagtagtccttgacaggcagcccagggccgctgtgctctcggaggtgctcctggagcagggcgccagggggaagaccgatgggcccttggtggagctgatgagacggtgacctggattcctgcccccagggttcgaagaagcccgtggtcattgtggtcatgaagtggcacagaaatatgtgcctgtgtccacagggtccacgttggtcaatgtaaggaccacctggtttttgacgtgtccttcgtgagcgtgagtctggtcgtcagagaaggactatatcgtatatcgtcattccaataagtgagtgcgatccactccagggccttttccggggggctgccgcacccagacaacgccctctccaggagtgacgagtgagaagcctgagacggtgcaggtcagcgtgaggtctgtgtgggtttcaccaatgtagggccagactctttcacggtgatctgggacaggccccatgaagggatggtcagcagcaggagcgtggagcaaagtgtgtccatggtggggcacaggagtccccccttactgactcactaaatcgagcaccgtcgtgtatatactgtctgatggcgcgagggaggcgatacg

SEQ ID NO: 794181 - DNA, 587 bp, Homo sapiens
  misc_feature: 76874.UNK.UNK.UNK.pb.heavy.1.raw 76874
ctatgcgcccttgccagcccgctcagacagtatataggaaagtagtcctgaccaggcagcccagggccgctgtgctctcggggtgctcctggagcagggcgccagggggaagaccgatgggcccttggtggaggctgaggagacgtggaccagggtttccctggccccacaaagtcaagccaggtgctggtgggctctcgcaacagaaatacacggccgtgtcctcagatctcaggctgctcagttccatgtagactgtacctggggggaggtgcccctggtcatactaactcctgcctggacttctgggcaagcccgtgttgccactaatagggggctttcatccatcccatccactccagcccttgtcccagcggcctgtcgcccccagttaattatcataattgatgaacgtgtatccagaagccgtgcaggagactgtcactggggccccaggcttctttcacctcagcagcgtggtgaccgtgacctccagcaacttcggcacccaaaaacccaaactactcacactaaatcgaggcaccggtcgtgtatatactgtctgatggcgcgagggaggcgatacg

SEQ ID NO: 794182 - DNA, 701 bp, Homo sapiens
  misc_feature: 76886.44.27.C05.1.pb.heavy.1.raw 76886
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaatacacggccgtgtcctgaggtctcaggctgttcatttgaagagacactgtgttctcggaattgtctctggagatggtgaatcggcccctcaacggaatcaccgtagacttgatttcctccatgaaatgacacacctgccacccactccagccctcgcctggagcctggcggaccactgcatattccaattatcgaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttcagtgctggctcgtctccagggctccccaacccttcgatcgcgtctaaatcgagcaccggtcgtgtatatactgtctgatggcgcgagggaggcgatacg

SEQ ID NO: 794183 - DNA, 705 bp, Homo sapiens
  misc_feature: 76906.44.27.C05.1.pb.heavy.1.raw 76906
cgtatcgcctccctcgcgccatcagacagtatatacacgaccggtgctcgatttagacgcgatcgaagggtttggggctgggagacgagcccagcactggaagtcgccggtgttttccactcggtgatcatcactgaacacagaggacttcaccatggagtttgggctgagctgggttttcctcgttgccctcttaagaggtgtcatgtgtcaggtgcaattcgtgagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794184 - DNA, 709 bp, Homo sapiens
  misc_feature: 76908.44.36.D03.1.pb.heavy.1.raw 76908
cgtatcggctccctcgcgccatcagaccagtatatagcacgaccggtgctcgattagctgcgtcacgatctctcttggggagctctgagagcggagccccagcccagaattcccagtgtgttttcattggtgatcagcactgaacacagaggactcaccatggagttcgggctgagctgggttttccttgttgttattttacaaggtgtccagagtgaagtgcagttggtggagtccgggggagacttggtccagctggagggtccctgagactctcctgtgtcgcctctggattcaccatcagtgaccactatatggactgcggtccgccaggctccagggaaggggctggagtggcttggccgcagtaaaaacaaagttgccagcttatcacagagtacgccgcgtcctgtgaaagccagattcaccctctcaagagatgacttcaagaactcattgattctgcgaatgactaacctgaaaaccgaggacacggcatgtatgtatttgtgttgtgtttatatcaggaactgtccactgcgggccagggaaccctggtcaccgtctcctcagcctccaccaagggcccatcggtcttccccctggcgccctggctccaggagcacctccgagagcacagcgccgctggctgcctggtcaaggactacttcctatatacctgttctgaggcggctggcaaggcgcatag

SEQ ID NO: 794185 - DNA, 708 bp, Homo sapiens
  misc_feature: 76932.44.27.C05.1.pb.heavy.1.raw 76932
cgtatcgcctccctcggcgccatcagacagtatatacacgaccggtgctcgatttagacgcgatcgaagggtttggggcctgggagacgagcccagcactggaagtcgccggtgtttcactcggtgatcatcactgaacacagaggactcaccatggagtttgggctgagctgggttttcctcgttgccctcttagaggtgtcatgtgtcaggtgcaattcgtggagtctggggaggcgtggccccagtaggggggctcgcctgagactctcctgtgcagcctctggattcaccttcgataattggaatatgcagtgggtccgccaggctccaggcgaggggctggagtgggtggcaggtgtgtcatttcatggaggaaatcaagtctaccggtgattccgttggagggccgattcacatctccagagacattcgagaacacagtgtctcttcaaatgaacagcctgagacctcaggacacggccgtgtattttgtgcgagactatctgtttccaaaatcggttcattcgacgcctggggccaggaacgcctggtcaccgtctcctcggcctccaccaagggcccatcgtcttccccctggcgccctgctccaggagccacctccgagagcacagcggccctgggctgcctggtcaaggactacttcctataatactgtggtctgagcgggctggcaaggcgccatag

SEQ ID NO: 794186 - DNA, 610 bp, Homo sapiens
  misc_feature: 76938.UNK.UNK.UNK.pb.heavy.1.raw 76938
cgtatcgcctccctcgcgccatcagacagtatattacacgaccggtgctcgatgagtatctgatagcctgggttttccttgttgctatttaaaaggtgtcagtgtgaggtgccagctgtggagtccggggagggctagttcagcctggggggtccctgagactctcctgtgcagcctctggattcaccttcagtagctactggatgcactgtccgccagctccagggaaggggctggtgtgggtctcacgtattaatagtgatgggagtagcacaagctacgcggactccgtgaagggccgattccaccatctccagagacaacgccaagaacacgctgtatctgcaaatgaacagtctgagagccgaggacacggctgtgtattactgtgcaagagccggtgcggagttcgggagttgcatactactactacggtatggacgtctggggccaaggaccacggtcaccgtctcctcagcttccccagggccatcggtcttcccctggcgccctgctccaggagcacctctggggcacagcggcccctgggctggcctggtcaaggactacttcctatatactgtctgagcgggctggcaaggcgccatag

SEQ ID NO: 794187 - DNA, 701 bp, Homo sapiens
  misc_feature: 76939.UNK.UNK.UNK.pb.heavy.1.raw 76939
cgtatcgcctccctcgccgccatcagacagtatatacacgaccggtgctcgatttagcactcgcaccgttgggtttggggggagaggagcccagcactgggattccgaggtgtttccattcggtgatcagcactgaacacagaggactcaccatggagttttggctgagctgggttctcctgttggacttttaaaaggtgtccagtgtgaggtgcggctgatgagtctggaggaggcttagtccagcctgggggtcccagagactctcctgtgcagcctctgggctcaccgtcagccagcaactacatgagttggtccgccaggctccagggaaggggctggagtgggtctcagtcatttatactggtgatttcacatactacgcagactccgtgaaggccgattcaccatctccagggacaattccaggaacacggtttatcttcaaatgaacaaccctgagaggcgacgacgacacggccgtctattactgtgcgagacaagtcgcgcctcggagtggttattattcgtttgacttctgggccaggggaaccctgtcaccgtcgcctccgcctccaccaagggcccatcgcttccccctggcacctcctccaagagcactctgggggcacagcggccctgggctgcctgtcaaggactacttcctatatactgtctgagcgggctgcaagcgcgcatag

SEQ ID NO: 794188 - DNA, 696 bp, Homo sapiens
  misc_feature: 76940.44.36.D03.1.pb.heavy.1.raw 76940
ctatgcgccttgccagcccgctcagacagtatataggaagtagtcttgaccaggcagcccagggccgctgtgctctcgaggtgctcctggagcagggcgccagggggaaaaccgatgggcccttggtggaggctgaggagacggtgaccagggttccctggccccagtggacagttcctgatataaacacaacacaataaatacatgcccgtgtctcggttttcaggttagtcattcgcagaatcaatgagttctgaagtcatctcttgagagggtgaatctggctttcacagacgcggcgtactctgtgataaagctggcaactttgttttactgcgccagccactccagcccccttccctggagcctggcggaccagtccatatagtggtcactgatgtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctggaattctgggctggggctccgctctcagagctccccaagagagatcgtgacgcagctaaatcgagcaccggtcgtgtatatactgtctgatggcgcgagggaggcgatacg

SEQ ID NO: 794189 - DNA, 615 bp, Homo sapiens
  misc_feature: 76943.44.23.C01.1.pb.heavy.1.raw 76943
cgtatcgcctcctcgcgccatcagacagtatatacacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctgagtttccatcagttctgatcattcttggggctggatccggcagcccccagggaggggaatggagtggattggtgacatccattatactgggggcgacgtactactctccgtccctcagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctctcagcttccaccaagggcccatcggtcttccccctggcgccctgctccaggagccacctctggggcacagcggccctgggctgcctggtcaaggactacttcc

SEQ ID NO: 794190 - DNA, 674 bp, Homo sapiens
  misc_feature: 76971.44.74.G08.1.pb.heavy.1.raw 76971
cgtatcgcctcctcgcgccatcagacagtatatacacgaccggtgctcgatttagtagctctatcaggggagcatcacataacaaccacatcctcctctaaagaagccctgggagcacagctcatcacatggactggacctggaggttcctcttgtggtggcagcagcacagtgtccagtccctggtgcaactggtgcagtctggactagaatgccgcaaccttggtcctcggtgacccttcctgcacggcctctggaagtactaccagttccactacttataccatcaactggtgcgcaggccctggacaagggcttgagtggatgggtggaatcatccctctttttgctcactcacctacgcacgagacttccggggcagaattacgattacgcggacaagtccacagacacagtctccatgacaatgagttctttgaaatccgacgacacggccgtctactactgtgcgagaggtccgtaccccagctcgcatggagcctttgagatctggggcagggaaccctggtcattgtcacctcagcttccaccaagggccatcggtcttcccctggcgccctgctccaggagcacctctgggggcacagcggcctgggctgcctggtcaaggactacttcctatatactgtctgagcggctggcaaggcgcatag

SEQ ID NO: 794191 - DNA, 702 bp, Homo sapiens
  misc_feature: 76981.UNK.UNK.UNK.pb.heavy.1.raw 76981
cgtatcgcctccctcgcgccatcagacagtatatacacgaccggtggctcgatttagctgcgtcacgatctctcttggggagctctgagagcggagccccagccccagaattcccaggtgttttcatttggtgatcagcactgaacacagaggactcaccatggagttcggctgagctgggtttccttgttgttattttacaaggtgtccagagtgaagtggcagttggtggagtccgggggagacttggtccagcctggagggtccctgagactctcctgtgtcgcctctggattcaccatcagtgaccactatatgggactgggtccgccaggctccagggaaggggctggagtggcttggcgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattggtgttgtgtttatatcaggaactgtccactggggccagggaaccctggtcaccgtctcctcagcctccaccaagggccatcggtcttccccctggcgcctgctccaggagcacctccgagagcacagcggccctggctgcctggtcaaggactacttcctatatactgtctgagcgggcggcaaggcgcatag

SEQ ID NO: 794192 - DNA, 702 bp, Homo sapiens
  misc_feature: 76983.44.55.E11.1.pb.heavy.1.raw 76983
cgtatcgcctccctcgcgccatcagacagtatatacacgaccggtgctcgatttagcactcgcacgttgggtttggggggagaggagcccagcactgggattccgaggtgtttccattcgtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggccctgggctgcctggtcaaggactacttcctatatacttctgagcgggctggcaaggcgcatag

SEQ ID NO: 794193 - DNA, 652 bp, Homo sapiens
  misc_feature: 76990.UNK.UNK.UNK.pb.heavy.1.raw 76990
ctatgcgccttgccagcccgctcagacagtatataggaagtagtccttgaccaggcagcccagggccgctgtgccccagaggtgctcctggagcagggcgccagggggaagaccgatgggcccttggtggaagctgagagacagtgaccaggggtgccacggcccatagattgaaagaccagtctcgcctcgcacagaaataaacggccgtgtccgcggcgggtcaccggaggtcagtttcagggagaagcggtcatggacgtgtccctcgaaatggtgagacgactcttgagggacggagagtagtacgtcgccccagtataatggatgtcaccaatcactccattcccctccctggggcctgccggatccagccccaagaatgatcagaactgatggaaactccagagacagtgcagatgagagacagggttcccgaaggcctcaccagtcctggcccgactcctgcagcctgcaccctggacaggacccatctgggagctgccaccagcaggaggaaaaaccacaggtgcttcatgttcttgcacaggaggtccttgactctcagaaagcatccccaaacccaagtctatagcactaaatcgagcaccgtcgtgtatatactgtctgatggcgcgagggaggcgatacg

SEQ ID NO: 794194 - DNA, 679 bp, Homo sapiens
  misc_feature: 76993.44.45.E01.1.pb.heavy.1.raw 76993
ctatgcgccttgccagcccgctcagacagtatataggaagtagtccttgaccaggcagcccagggccgctgtgctctcggaggtgctcctggagcagggcgccaggggggaagaccgatgggcccttggtggaggctgaggagacggtgaccagggctccctggccccagtagaacgatgggctcgtacaataatagagagccgagtcctcggctctcaaattgttcatttgtagatacacggtgtcttggaattgtctctggagacggagaatcggcccttcacggagtttccatagtattctttacttccatcagaccagatgactgccacccactccagcccttgcctggagcctggcggacccagtgcatggcagagtcactgaaactgagtccggacgcaacacaggagagtctcaggacgtcccaggctggaccacgcctccccagactccaccagctgaacctgacactgacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794195 - DNA, 710 bp, Homo sapiens
  misc_feature: 76994.44.74.G08.1.pb.heavy.1.raw 76994
ctatgcgccttgccagcccgctcagacagtatataggaagtagtccttgaccaggcagcccagggccgctgtgcccccaagggtgctcctggagcagggcgccagggggaagaccgatgggcccttggtggaagctgaggtgacaatgaccagggttccctgccccccagatctcaaaggctccatgcggagctgggggtacggacctctcgcacagtagtagacggccgtgtcgtcggatttcaaagaactcattgtcatggagactgtgtctgtggacttgtccgcggtaatcgtaattctgccccggaagtctcgtgcgtaggtggagtgagccaaaaaagagggatgattcccacccatcccactcaagccccttgtccaggggcctggcgcacccagttgatggtataagtagtgggaactggtagtacttccaggaggccggtgcaggaaagggtcaccgagggaccaaggttgcggcattctagtccccagactgcaccagttgcaccagggactggacacctggttgctgctgccaccaccaaagaggaacctccaggtccagtcccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 794196 - DNA, 638 bp, Homo sapiens
  misc_feature: 76995.44.86.H09.1.pb.heavy.1.raw 76995
ctatgcgccttgccagcccgctcagacagtatataggaagtagtccttgacaggcagccagggcgctgtgccccagaggtgctcctggagcaggcgccagggggaagaccgatgggcccttggtggaagctgaggagacagtgacagggtgccacggccccatagattgaaagaccagtctcgcctcgcacagaaataacggccgtgtccgcggcggtcacggaggtcagtttcaggagaagcggttcatggacgtgtccctcgaaatggtgagacgactcttgagggacggagagtagtacgtcgcccagtataatggatgtcaccaatccactccattcccctccctgggggctgcggatccagcccagaatgatcagaactgatggaactccagagacagtgcagatgagagacagggttccgaaggcctcacccagtcctgggcccgactcctgcagctgcacctggacaggacccatctgggagctgccaccagcaggaggaaaaccacaggtgcttcatgttcttgcacaggaggtccttgactctcagaaagcatccccaaacccaagtctatagcactaaatcgagcaccggtcgtgtatatactgtctgatggcgcgaggaggcgatcg

SEQ ID NO: 794197 - DNA, 701 bp, Homo sapiens
  misc_feature: 77009.44.67.G01.1.pb.heavy.1.raw 77009
cgtaatcgcctccctcgcgccatcagacagtatatacacgaccggtgctcgatttagagtatacatattgggtttgggggggagaggagcccagcactggattccgaggtgtttccattcggtgatcagcactgaacacagaggactcaccatggagttttggctgagctggttctccttgttggacttttaaaaggtgtccagtgtgaggtgcggctgatggagtctggaggagcttagtccagcctgggggggtccagagactctcctgtgcagcctctgggctcaccgtcagcagcaactacatgagttgggtccgccaggctccagggaaggggctggagtgggtctcagtcatttatactggtgatttcacatactacgcaggactccgtgaagggccgattcaccatcccaggacaattccaggaacacggtttatcttcaaatgaacaacctgagaggcgacgacacggccgtctattactgtgcgagacaagtcggcgctcggagtggttattattcgtttgacttctggggccagggaaaccctggtcaccgtcgcctccgcctccaccaagggcccatcggtcttcccctggcaccctcctccaagagcacctctggggcacagcggcctgggctgcctggtcaaggactacttcctatatactgtctgagcgggctggcaaggcgcatag

SEQ ID NO: 794198 - DNA, 696 bp, Homo sapiens
  misc_feature: 77014.44.27.C05.1.pb.heavy.1.raw 77014
ctatgcgccttgccaagcccgctcagacagtaatataggaagtagtagtcttgaccaggcagcccagggccgctgatcttctcggaggtgctcctggagccagggggaaccaggggaagcatgggcccttggtggatggccgaggagacggtgaccagggtccctggcccaggcgtcgaatgaaccgattttggaaacagatagtctcgcacaaaaatacacggccggtgtcctgaggtctcaggctgttcatttgagagacactgtgtttcggaattgtctctggagatggtgaatcggcctcaacggatatcaccgtagactgatttcctcatgaaatgacacaccgcacccactcagccctgcctgggagcctggcggacccactgcatattcaattatcgaagtgaatccagaggctgcacaggagagtctcaggaccccctactgggccacgcctccccagactccaccgaattgcactgacacatgacacctcttaagagggcaacgaggaaaacccagctcagcccaaactccatgtgagtcctctgtgttcagtgatgatcaccgagtggaaacaccggcgacttcccagtgctggctcgtctccccagcccaaaccttcgatcgcgtctaaatcgagcaccggtcgtgatatatactgtctgatggcgccccggaggaggcgatacg

SEQ ID NO: 794199 - DNA, 718 bp, Homo sapiens
  misc_feature: 77029.44.36.D03.1.pb.heavy.1.raw 77029
ctatgcgccttgccagcccgctcagacagtatataggaagtagtcccttgacaggcagcccaggggccgctgtgctctcggcggaggtgctcctggagcagggcgccagggggaagaccgatgggcccttggggaggctgaggagacggtgaccagggttcccctggcccagtggacagttcctgatataaacacaaaccaataatacatgcccgtgtcctcggttttcaggttagtcattcgcagaatcaatgaaagttcttgaagtcatctcttgagagggtgaatctggctttcacagacgcggcgtactctgtgaaaaagctggccaactttgtttttactggcgggccaagccactccagccccttccctggaagcctggcggacccagtcatatagtggtcaactgatggtgaatccagaggcggacacaggagaggtctcagggacctccaggctggaccaagtctcccccggactccaccaactgcacttcactctggacaccttgtaaaataacaacaaggaaaacccagctcagcccgaaactccatggtgagtcctctgtgttcagtgctgatcaccaaaatgaaaacacctgggaattctggggctggggcctcccgctctcccgcccacaagagacgatcgtgacgcagctaaatcgagcaccggtcgtgtatatactgtctgatggcgcgagggaggcgatacg

SEQ ID NO: 794200 - DNA, 726 bp, Homo sapiens
  misc_feature: 77033.44.55.E11.1.pb.heavy.1.raw 77033
cgtatcggcctcccctcgcgcccatcagacagtatatacacgaccggtgctcgatttagcactcgcacgttgggtttgggggggagaggagcccagcactgggattccggaggtgtttccattcggtgatcagcactgaacacagaggactcaccatggagtttttggcctgagctgggttctcctttgtttggacttttaaaaggtgtccagtgtgaggtgccggctgatggagtctggagggaggcttagtccagcctgggggttccagagactctcctgtgcagcctctggggctcaccgtcagcagcaaactacatgagttgggtccgccaggctccagggaaggggctggagtgggtctcagtcatttatactggtgatttcacatactacgcagactccgtgaagggctgattcacatctccagggacaattccaggaacacggtttatcttcaaatgaacaacctgagaggcgacgacacggccgtctattactgtgcgagacaagtcggcgctccggagtggttattatttcgtttgacttctgggccagggaaccctggtcacccgtccgcctcgcgcctccaccaagggcccatcggtcttcccccctggcaccccttcctccaagagcacctctgggggcacagcggccctgggctgcctggtcaaggactacttcctatatactgtctgagcggcgggctggcaaggcgcatag

SEQ ID NO: 794201 - DNA, 619 bp, Homo sapiens
  misc_feature: 77051.44.23.C01.1.pb.heavy.1.raw 77051
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794202 - DNA, 593 bp, Homo sapiens
  misc_feature: 77053.UNK.UNK.UNK.pb.heavy.1.raw 77053
atgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgacgtccccctgccccagacatccatcaaatagtagtagtttatgattccccgaaccgtttccttggaggtccccctcgcacagtaataaacagacgtgtcgtccaactctcacgctgttcatttgcaaatacagcatattcttggaattgtctctggagatggtgaatcggccttcacggagtctgagtaatacttctcacttccatcgtcggagatgactgccacccactccggcccttgcctggagcctggcggacccagtgcaaaccaaatctatcgaatgagaacccagaggctacacaggagagtctcagggacctcccgggctggaccacgcctcccccagactccaccaagtgctcctgacactggacacctcttaaaagagcaacgaggaaaacccagctcagcccaaactccatggtgagtcctctgtgttcag

SEQ ID NO: 794203 - DNA, 716 bp, Homo sapiens
  misc_feature: 77071.44.56.F01.1.pb.heavy.1.raw 77071
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgaccattgtcccctggccccaaatatcaaatgcatcgacgtcccaggatcgcctggcgcagtaatagaccgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 794204 - DNA, 544 bp, Homo sapiens
  misc_feature: 77076.44.38.D05.1.pb.heavy.1.raw 77076
cgtatcgcctccctcgcgccatcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 794205 - DNA, 695 bp, Homo sapiens
  misc_feature: 77083.44.9.A09.1.pb.heavy.1.raw 77083
cgtatcgcctccctcgcgccatcagacagtatatacacgaccggtgctcgatttagcgagacgcgcagggggggagacgagcccagcactggaagtcgccggtgtttccattcggtgatcatcactgaacacagaggactcaccatggactttgggctgagatgggtttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggcccctgggctgcctggtcaaggactacttcctatatactgtctgagcgggctggcaaggcgcatag

SEQ ID NO: 794206 - DNA, 698 bp, Homo sapiens
  misc_feature: 77085.44.36.D03.1.pb.heavy.1.raw 77085
cgtatcgcctccctcgcaccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaagg

SEQ ID NO: 794207 - DNA, 549 bp, Homo sapiens
  misc_feature: 77094.44.43.D10.1.pb.heavy.1.raw 77094
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccagggttccctggcccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggccccaggcttcttcacctcagccccttactgctagtctaaatcgagcaccggtcgtgtatatactgtctgatggcgcgagggaggcgatacg

SEQ ID NO: 794208 - DNA, 704 bp, Homo sapiens
  misc_feature: 77096.44.36.D03.1.pb.heavy.1.raw 77096
ctatgcgccttgccagcccgctcagacagtatataggaagtagtccttgacccaggcagcccagggccgctgtgctctcggaggtgctcctggagcagggcgccagggggaagaccgatggcccttggtggaggctgaggagacggtgaccagggttccctggccccagtggacagttcctgatataaacacaacacaataatacatgcccgtgtcctcggttttcaggtttagtcattcgcagaatcaatgagttcttgaagtcatctcttgagagggtgaatctggcttttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctcaggctggaccaagttctcccccggactccaccaactgcacttcactctggacaccttgtaaaataacaacaaggaaaacccagctcagccgaactccatggtgagtcctctgtgttcagtgctgatcaccaatgaaaacacctgggaattctgggctggggctccgctctcagagctccccaagagagatcgtgacgcagctaaatcgagcaccggtcgtgtatatactgtctgatggcgcgagggaggcgatacg

SEQ ID NO: 794209 - DNA, 681 bp, Homo sapiens
  misc_feature: 77098.44.53.E09.1.pb.heavy.1.raw 77098
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggatttccttgctgctattttaaaaggtgtccagtgtgaggtgcagttggtggagtctgggggaggtttggtaaagcctgggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794210 - DNA, 720 bp, Homo sapiens
  misc_feature: 77109.UNK.UNK.UNK.pb.heavy.1.raw 77109
ctatggcgccttgccagcccgctcagacagtatataggaagtagtccttgaccaggcagcccagggccggctgtgctctcgaggtgctcctggagcagggcgccaggggggaagaccgatgggcccttggtggaggccgaggagacggtgaccagggttcccgggccccaggcgtcgaatgaaaccgattttggaacagatagtctcgcacaaaaatacacggccgtgtcctgaggtctcaggctgttcatttgaaagagacactgtgttctcggaattgtctctggagatggtgaaatcgggccctcaacggaatcaccgtagaacttgatttcctccatgaaatgacacacctgccacccactccagcccctcgcctggagcctggcggacccactgcatattccaattatcgaaggtgaatccagaggcctgcacaggagagtctcagggacccccctactgggccacgctcccccagactccacgaattgcacctgacacatgacacctcttaagagggcaacgagggaaaacccagctcagcccaaactccatggtgagtccctctgtgttcagtgatgatcaccgagtggaaacaccgggcgacttccgtgggctgggctcgtctcccagggccccccaaacccttcgatccgcgtctaaatcgagcaccggtcgtgtatatactgtctgatggcggccgagggaggcgatacg

SEQ ID NO: 794211 - DNA, 713 bp, Homo sapiens
  misc_feature: 77130.UNK.UNK.UNK.pb.heavy.1.raw 77130
cgtatcgcgctccctccgccgccatcagacagtatatacacgacgggtgctcgattagccactcgcacgttggggtttggggagaggagcccagcactgggattccgaggtgtttccattccggtgatcaggcactgaacacagaggactcaccatggagttttggctgaggctgggttctccttgttggactttaaaaggtgtccagtgtgaggtggcgctgatggagtctggaggaggcttagtccagcctgggggtcccagagactctcctgtgccagcctctggggctccaccgtcagcagcaactaacatgagttgggtccgccaggctccagggaaggggctggagtgggttctcagtcatttatactggtgatttcacaatactacgcaagactccgtgaagggccgattcaccatctccagggacaattcaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggccctgggctgcctggtcaagactacttcctatatactggtctgagcggctggcaaggcgccatag

SEQ ID NO: 794212 - DNA, 705 bp, Homo sapiens
  misc_feature: 77132.44.9.A09.1.pb.heavy.1.raw 77132
ctatgccgccttgccagcccgcctcagacagtatataggaaggtagttccttgacccaggcagcccaggccgctgtgctctcggaggtgctcctggaggcaggggcgccaggggagaccgatgggcccttggtggaggctgaggagacggtgaccagggttccctggccccagtagtcaagccggcggacgtctcgagggggctctcgcacaataatagacagccgtgtcctcacttgtgaggttgtacatttgcagatgcagtgtgttcctgggaattgtctctggagacggtgaatcgcccttctcggagtctccgttagtgttcttcaattccatcttctgatataattgccacccactccaggccccttgcctggagcctggcggacccagtgcatggcataggtcctgaagatgaatccagaggctgcacaggagagtctcagggagtttcccaggctgggcgctcctcccccagaactccactagctgcacctgacactggccaccttcttaaaagagcacgaggaaaacccatctcagccccaaagtccatggtgagtcctctgtgttcagtgatgatcacgaaatgggaaacaccggcgacttccagtgctgggctcgtctccccccctgcgcgtctcgctaaatcgagcaccggtcgtgtatatatactgtctgatggcgcgagggaggcgatacg

SEQ ID NO: 794213 - DNA, 709 bp, Homo sapiens
  misc_feature: 77134.UNK.UNK.UNK.pb.heavy.1.raw 77134
atgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctgcccccaggcgtcgaatgaaccgattttggaaaacagatagtctcgcacaaaaatacaacggcccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactggcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaaactcatggtgagtcctctgtgttcagtgatgatcaccgagtggaaacaccggcgacttccagtgctgggctcgtctccaggctccccaaacccttcgatcgcgtctaaatcgagcacggtcgtgtatatactgtctgatgggcgcgaggggaggcgatacg

SEQ ID NO: 794214 - DNA, 665 bp, Homo sapiens
  misc_feature: 77139.44.38.D05.1.pb.heavy.1.raw 77139
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtctcggctctcagactgttcatttgcagatacagcgtgttcttgcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctccccatgcccacggtgcccagagccaaatcttgtgacacacctccccgtgcccaaggtgcccagcacctgaactcctgggaggaccgtcagtcttcctcttccccccaacccaactatcagatactaaatcgagcaccggtcgtgtatatactgtctgatggcgcgagggaggcgatacg

SEQ ID NO: 794215 - DNA, 702 bp, Homo sapiens
  misc_feature: 77146.44.55.E11.1.pb.heavy.1.raw 77146
ctatgcgccttgccagcccgctcagacagtatataggaagtagtccttgaccaggcagcccagggccgctgtgccccagaggtgctcttggaggagggtgccaggggaagaccgatgggcccttgtggaggcggaggcgacggtgaccaggttccctggccccagaagtcaaacgaataataaccactccgagcgccgacttgtctcgcacagtaatagacggccgtgtcgtcgcctctcaggttgttcatttgaagataaacgtgttcctggattgtccctggagatgggaatcggccttcacggagtctgcgtagtatgtgaaatcaccagtataaatgactgagaccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccacaaggagaaacccagctcagcaaaactccatggtggagtcctctgtgttcagtgctgatcaccgaatggaaacacctcggaatcccagtgctggggctcccctctccccccccaaacccaacgtgcgagtgctaaatcgagcaccggtcgtgtatatacgtctgatggcgcgaggggaggcgataccg

SEQ ID NO: 794216 - DNA, 597 bp, Homo sapiens
  misc_feature: 77147.UNK.UNK.UNK.pb.heavy.1.raw 77147
aggctgggcaggctatgcaccctggtccaggtcaaaagctgcggaaccgctagcggccatcttggcactagggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatccgtcagtcctatcgcgcgcatcaagacctggttgttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcgg

SEQ ID NO: 794217 - DNA, 637 bp, Homo sapiens
  misc_feature: 77153.44.86.H09.1.pb.heavy.1.raw 77153
ctatgcgccttgccagcccgctcagacagtatataggaagtaagtccttgaccaggcagcccagggccgctgtgcccagaggtgctcctgagcagggcgccagggggaagaccgatgggccttggtggaagctgaggagacagtgaccagggtgccacggcccatagattgaaagaccagtctcgcctcgcacagaaataaacgccgtgtccgcgcggtcacgagtcagtttcaggagaagcggttcatggacgtgtccctcgaaatggtgagacgactcttgaggacggagagtagtacgtcgccccagtataatggatgtcaccaatcactccattccctccctgggggctgccggatccagccccaagaatgatcagaactgatggaaactccagagacagtgcagatgagagacagggttccgaaggcctcaccagtcctggcccgactcctgcagctgcacctggacagacccatctgggagctgccaccagcaggaggaaaaaccacaggtgcttcatgttcttgcacaggaggtccttgactctcagaaagcatcccaaacccaagtctatagcactaaatcgagcaccggtcgtgtatatactgtctgatggcgcgaggaggcgatacg

SEQ ID NO: 794218 - DNA, 730 bp, Homo sapiens
  misc_feature: 77184.UNK.UNK.UNK.pb.heavy.1.raw 77184
cgtatccgcctccctccgcgccatcagacagtatatacacgacccggtgcttcgatttagctgcgtcacgatctctcttgggagctctgagagcggagcccagccccagaaattcccaggtgtttttcatttggtgatcagcactgaacacagaggaactcaccatggagtttcggggctgagctgggtttttcctttgttgttattttaacaagggtgtccagagtgaagtgcagttggtggagtccgggagaacttggtccagcctggagggtccctgagactctcctgtgtcgcctctggatttcaccatcagtgaccactaatatggactgggtccgccaggctccaggaaaaggggctggagtggcttggcccgcagtaaaaaacaaagtttgccagctttatcacagagtaccgccgcgtctgtgaaagccagattcaccctctcagagatgactttcaagaactcattgattttgcgaatgaactaacctgaaaacccgagacaacgggcatgtattattgtgttgtttgtttatatcaggaactgtccactggggccagggaaccctggttcaccgtctcctcagcctccaccaagggcccatcggtttttccccctggcgcctgctccaggagcacctccgagagcacaagcggccctgggctgccctggtcaaggactactttcctatatactgttctgagcggctggcaaggcgcatag

SEQ ID NO: 794219 - DNA, 648 bp, Homo sapiens
  misc_feature: 77186.UNK.UNK.UNK.pb.heavy.1.raw 77186
cgtatcgcctcctcgcgccatcagacagtatatacacgaccgtgctcgatttagtactgatagttgggtttgggggaagaggaagactgacggtcctcccaggagttcagggctgggcaccttggccggggaggtgtgtcacaagatttgggctctgggcaccgtgggcatggggagcttagttcagcctgggggtccctgagactctcctgtgcagcctctggattcaccttcagtagctactggatgcactggtccgccaagctccaggaaggggctggtgggtctcacgtattaatagtgatgggagtagcacaagctacgcggactccgtgaaggccgattcaccatctccagagacaacgccaagaacacgctgtatctgcaaatgacagtctgagagcgaggacacggctgtgtattactgtgcaagagccggtgcgggagttcgggagttgcatactactactacggtatggacgtctggggccaaggaccacggtcaccgtctcctcagctccaccaagggcccatcggtcttcccctggcgccctgctccaggagcacctctggggcacagcggccctgggctgcctggtcaaggactacttcctatatactgtctgagcgggctggcaaggcgcatag

SEQ ID NO: 794220 - DNA, 570 bp, Homo sapiens
  misc_feature: 77188.44.36.D03.1.pb.heavy.1.raw 77188
gatcgtatcgcctcctcgcgccatcagacagtatatacacgaccggtgctcgattttagctgcgtcacgatctctcttggggacccagcttctgatgaactctcctgttgccagcgtccatggcctcagtgaaggtctcctgcaaagctctgggatacaccttcgccagctacgacattcactgtgtgtgacaggcccctggataagggtttgaaatggatggtagggagctactctggcaatggtaacacaggctatgcacagaagtttcagggcagagtcaccatgaccagggacacgtccacgagcacagcctaccatggagctgagcagtcagagatctgaggacatagatgtgtactactgtgcgagaccggtagaggacaagcaagaaaagaagttcttttgactactggggccagggaaccctggtcaccgtctcctcagcctccaccaaggcccatcggtcttccccctggcaccctcctccaagagcacctctgggggcacagcggccctggctgcctggtcaaggactacttcctatatactgtctgagcgggctggcaa

SEQ ID NO: 794221 - DNA, 563 bp, Homo sapiens
  misc_feature: 77208.UNK.UNK.UNK.pb.heavy.1.raw 77208
cgtatcgcctcctcgcgccatcagacagtatatacacgacggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacagccgctggacaagggctggagtggatgggatggatgaagccctatagtggcaacacggctttgcccagaagttccaaggcagagttagtatgaccaggagcacctccccaggtacagtcacatggaactgagcagcctgagatctgaggacacggccgtgtatttctgtgcgagagccaccagcacctggcttgacttgtgggccagggaaccctggtcaccgtctcctcagcctccacaagggcccatcggtcttcccctggcgccctgctccaggagcacctccgagagcacagcggcctgggctgcctggtcaaggactacttcctatatactgtctgagcgggctgcaaggcgcatag

SEQ ID NO: 794222 - DNA, 661 bp, Homo sapiens
  misc_feature: 77224.44.86.H09.1.pb.heavy.1.raw 77224
ctatgcgccttgccagcccgctcagacagtatataggaagtagtccttgaccaggcagcccagggccgctgtgcccccagaggtgctcctggagcagggcgccaggggggaagaccgatgggcccttggtggaagctgaggagacagtgaccagggtgccacggccccccatagattgaaagaccagtcctcgcctcgccacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctcccctggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccacccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 794223 - DNA, 700 bp, Homo sapiens
  misc_feature: 77237.UNK.UNK.UNK.pb.heavy.1.raw 77237
cgtatcgcctccctcgcgccatcagacagtatatacacgaccggtgctcgatttaggtgtcgtcgcaagagagagggcccagccctgggggactgaacagagagaactcaccatggagtttgggcctgagctggctttttcttgtggctgttttaaaaggtgtccagtgtgaagtgcagctgttggagtcggggggaggcttggtacagccgggggggtccctgacactcttcctgtgcagcctctggattcgcctttaatacctatgccatgatctggggtccgtcaggccccagggaaggggctggagtgggtctcatccattactggtggtagtgccacaaatgtccgcagactccgtgaagggccgcttcatcgtctccaggcgacaattccaagaatacggtgtttctggcagatgaagagcctgcgagtggacgacacggccctttattactgtgccagagggtcgcagaagttacaacaatacaagtattactactacatggacgtctgggggcaaaggggacccccccggtcaccggtctcctcagcctccacccaaggcccatcggtcttcccccccctggcaccctcgcctccagagagcacctctggggggcacaggcggcctgggcctgccttggtcaaggaactaacttcctatatacctgtctgagcgggctggcaaggcgcatag

SEQ ID NO: 794224 - DNA, 616 bp, Homo sapiens
  misc_feature: 77239.44.23.C01.1.pb.heavy.1.raw 77239
cgtatcgcctccctcgcgcccatcagacagtatatacacgaccggtgctcgatttagtacacgtgattagggattggggccaggggaacacctgtggtttttcctcctgctgtggcagctcccagatgggtcctcgtcccaggtgcagctgcaggagtcgggcccaggactggtgaggccttcgggaaccctgtctctcatctgcactgtctctggagtttccatcagttctgatcattctggggctggatccggcagccccagggaggggaatggagggattggtgacatccattatactggggcgacgtactactctccgtccctcaagagtcgtctcaccatttcgagggacacgtccatgaaccgcttctccctgaaactgacctccgtgacgccgcggacacggccgtttattctgtgcgaggcgagactggtctttcaatctatggggccgtggccaccctggtcacgtgtctcctcagcttcaccaagggccatcggttcttccccctggcgccctgctccaggagcacctctgggggcacagcggccctggctgcctggtcaaggactacttcctatatactgtctgagcgggctggcaaggcgcata

SEQ ID NO: 794225 - DNA, 685 bp, Homo sapiens
  misc_feature: 77250.UNK.UNK.UNK.pb.heavy.1.raw 77250
cgctatcgcctccctccgcccgcatcagacccggacagtaatatacacccgaccgggtgctcgatttagtgctatagactttgggtttcggggatgctttcctgagagtccaaggaccttcctgtgcaagaacctgaaagcacctgtggtttttccctcctgctggtggcagctcccagatgggtcctgtcccaggtgcagcgctgccaggagtcggggcccaggactgggtgaggcttcgggaaccctgtctctcatctgcactgtctctggagtttccatcagttctgatcattccttggggctggatccggcagcccccagggagggaggaatggagtggattggtgagcatccattatactggggcgaccgtactactctccgtccctcaagagtcgtctcaccatttcgaggggacacgtccatgaacccgcttctccctgaaaactgacctccgtgaccgccgcggacacggccgtttatttctgtggcgaggccggagactcggtctttcaatctatggggccgtggcaccctggtcactgtctcctcagcttccaccaagggcccatcggtcttccccctgggcgccctgctccccgccgacggagcacctctgcggggcacagcgcccctgggctgcctggtcaaggactacttcctatatactgtctgagcgggc

SEQ ID NO: 794226 - DNA, 703 bp, Homo sapiens
  misc_feature: 77252.44.27.C05.1.pb.heavy.1.raw 77252
ctatgcgccttgccagcccgctcagacagtatataggaagtagtcttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaaagagacactgtgttctcggaattgtctctggagatggtgaatcggccctcaacggaatcaccgtagacttgatttcctccatgaaatgacacacctgccacccactccagtccctcgcctggagcctggcggaccactgcatattccaattatcgaaggtgaatccagaggctgcacaggagagtctcagggacccccctactgggcacgcctcccccagactccacgaattgcaccctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcaccggtcgtgtatatactgtctgatggcgcgagggaggcgatacg

SEQ ID NO: 794227 - DNA, 710 bp, Homo sapiens
  misc_feature: 77258.UNK.UNK.UNK.pb.heavy.1.raw 77258
cgtatcgcctcccctcgcgccatcagacagtatatacacgaccggtgctcgatttagctggcgtcacgatctctcttgggagctctgagagcggagccccagccccagaattcccaggtgtttttcattggtgatcagcactgaacacagaggactcaccatggaagttcgggctgagctgggttttccttgttgttatttacaaggtgtccagcagtgaagtgcagttggtggagtccgggggagacttggtccagcctggagggtccctgagactctcctgtgtcgcctctggattcaccatcagtgaccactatatggactgggtccgccaggctccagggaaggggctggagtggcttgccgcagtaaaaacaaagttgccagctttatcacagaggtacgccgcgtctgtgaaagccagattcaccctctcaagagatgacttcaagaactcattgattctgcgaatgactaacctgaaaaccgagggacacgggcatgtattattgtgttgtgtttatatcaggaactgtccactggggccagggaccctggtcaccgtctcctcagcctccaccaagggcccatcggtcttccccctggcgccctgctccaggagcacctccgagagcacagcgggccctgggctgcctggtcaaggactacttccatatatactgtctgagcggggctggcaaggcgcatag

SEQ ID NO: 794228 - DNA, 586 bp, Homo sapiens
  misc_feature: 77259.UNK.UNK.UNK.pb.heavy.1.raw 77259
cgtatcgcctccctcgcgccatcagacagtatatacacgaccgtgctcgatttagtgtgagtagtttgggtttggggggaagaggaagactgacggtcccactccaggtacagctgggcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtgggcaacacgggctttgccagaagttccaaggcagagttagtatgaccaggagcacctccccaggtacagtctacatggaactgagcagcctgagatctgaggacacgccgtgtatttctgtgcgagagccaccagcacctggcttgacttgtggtgccagggaaccctgtcaccgtctcctcagcctccaccaagggcccatcggtcttccccctggcgccctgctccaggagcacctccgagagcacagcggcctgggctggcctggtcaaggactacttctatatactgtctgagcggctggcaaaggcgcatag

SEQ ID NO: 794229 - DNA, 644 bp, Homo sapiens
  misc_feature: 77260.44.57.F02.1.pb.heavy.1.raw 77260
ctatgcgccttgccagcccgctcagacagtatataggaagtagtccttgaccaggcagcccagggcgctgtgccccagaggtgctcctggagcagggcgccagggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatgacgtgtccctcgaaatggtgagacgactcttgagggacggagagtagtacgtcgcccagtataatggatgtcaccaatccactccattcccctccctgggggctgcggatccagcccaagaatgatcagaactgatggaaactccagagacagtgcagatgagagacagggttcccgaagcctcaccagtcctgggcccgactcctgcagctgcactgggacaggacccatctgggagctgccaccagcaggaggaaaaaccacaggtgcttcatgttcttgcacaggaggtcttgactctcagaaagcatccaaacccaactatatcgagctaaatcgagcaccggtcgtgtatatactgtctgatggcgcgagggaggcgaatacg

SEQ ID NO: 794230 - DNA, 612 bp, Homo sapiens
  misc_feature: 77268.44.38.D05.1.pb.heavy.1.raw 77268
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacggtgaccgtggtccttggcccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagcccttccctggagcttggcggacccagtgcatccagtagctactgaaggtgaatccagaggctgcacaggagagtctcagggacccccaggctgaactaagcctccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 794231 - DNA, 667 bp, Homo sapiens
  misc_feature: 77270.44.23.C01.1.pb.heavy.1.raw 77270
cgtatcgcctcctcgcgcccatcagtctatactaaatcacgaccggtgctcgatttagtacacgtgattagggattggggatgctttctgagagtcaaggacctcctgtgcaaggacatgaaggcacctgtggtttttcctcctgctggtggcagctcccagatgggtcctgtcccaggtgcagctgcaggagtcgggcccaggactgtgagggccttcgggaaccctgtctctcatctgcactgtctctggagtttccatcagttctgatcattctggggcttggatccggcagcccccagggaggggaatggagtggatggtgacatccattatactggggcgacgtactactctccgtccctcaagagtccgtctcaccatttcgagggacacgtccatgaaccgcttctccctgaaactgacctccgtgaccgccgcggacacggccgtttatttctgtggcgaggcgagactggtctttcaatctatggggccgtggcaccctggtcactgtcttcctcagcttccaccaaggggccccatcggtcttccccctggcgccctgccccaggagcagcctctgggggcccagcccgcggccctggcctgcctggtcaaggactacttcctatatactgtctgagcgggctggcaaggcgcatag

SEQ ID NO: 794232 - DNA, 717 bp, Homo sapiens
  misc_feature: 77276.UNK.UNK.UNK.pb.heavy.1.raw 77276
ctatgcgccttgccagcggcgctcagaacagtatataggaagtcagtccttgaccaggcagcccagggcctgctgtgcctccgggaggtgctcctggagcagggcgccagggggaagaccgatgggcccttgggtcggagggcgaggagacggtgaccagggttccctggcgccaggcgtcgaatggaaccgattttggaaaacagatagtccgcacaaaatacacggccgtgtcctgaggtcttcaggtacctgttcatttgaagagacactgtgctctcggaattgtctcttggagatgcgtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcaggacctccccttacctggccacgcctccccagaactccacgaattgcacctgacacatgacacctcttaagaggcaacgaggaaaaccagctcagcccaaactccatggtgagtcctctgttgttcagtgatgattcaccgagtggaaacacgcgcgacttccagtgctgggctcgtctcccagccaaacccttcgaatcgcggtctaaatcgagcaccggtcgtgtatatactgtctgatggcgcgagggaggcgatacg

SEQ ID NO: 794233 - DNA, 682 bp, Homo sapiens
  misc_feature: 77277.44.45.E01.1.pb.heavy.1.raw 77277
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcgctctcaaattgttcatttgtagatacacggtgttcttggaattgtctctggagacggagaatcggcccttcacggagttttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794234 - DNA, 721 bp, Homo sapiens
  misc_feature: 77286.UNK.UNK.UNK.pb.heavy.1.raw 77286
ctatgcgccttgccagcccgctcagacagtatataggaagtagtccttgaccaggcagcccagggccgctgtgctctcggaggtgctcctggagcagggcgccagggggaagaccgatgggcccttggtgggaggcctgaggagacggtgaccagggttccctggccccagtagtcaagccgggaccgtctcgaggggctctcgcacaataatagacagccgtgtcctcacttgtgaggttgtacatttgcagatgcccagtgtgttcctggaattggtctctgggagacggtgaatcggcccttctcgagtctccgtagtgttcttcaattcccatcttctgatataattgccacccactccagcccttgcctggagcctggcggacccagtgccatggcaataggtcctgaagatgaatccagaggcctgcaccaggagcagtctcagggagttcccaggctgggccgcctccctcccccagactcactagctgccacctgacactggccacctcttttaaaagagcaacgaggaaaaaaccatctcaggccccaaagtcccatggtgagtcctctgtgttcagtgaatgatcacccgaatggaaacaccggcggacttccagtgcctggggcctcgtcccccccctgaggcgttagagctaaatcgagcaccggttcgtcggtatatactgtctgatggcgccgagggaggcgatacg

SEQ ID NO: 794235 - DNA, 702 bp, Homo sapiens
  misc_feature: 77288.44.55.E11.1.pb.heavy.1.raw 77288
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccacacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaatcgagcaccggtcgtgtatatactgtctgatggcgcgagggaggcgatacg

SEQ ID NO: 794236 - DNA, 664 bp, Homo sapiens
  misc_feature: 77292.UNK.UNK.UNK.pb.heavy.1.raw 77292
cgtatcgcctccctcgcgccatcagaacagtatatacacgaaaccggtgctcgatttagctcgatatagttgggtttgggatgcttttctgagagtcaaggacctcctgtgcaagaacatgaagcacctgtggtttttcctcctgctggtggcagctcccagatgggtcctgtccaggtgcagctgcaggagttcgggcccaggactggtgaggccttcgggaaccctgttctcttcatctgcactgtctctgagtttccatcagtttctgatcattcttgggggctggatccggcagcccccagggaggggaatggagtggattggtgacatccattatactggggcgacgtactactctccgtccctcaagagtcgtctcaccatttcgagggacatgtccatgaccgcttctccctgaaaactgacctccgtgaccgccgcggacacggccgttatttctgtgcgaggcgagactggtctttcaatctatggggccgtggcaccctggcactgtctcctcagcttccaccaagggcccatcggtcttccccctggcgccctgcttccaggagcaacctctgggggcacagcggccctgggctgcctggtcaaggactacttccttatataactgtctgagccgggctggcaaggcgcatag

SEQ ID NO: 794237 - DNA, 678 bp, Homo sapiens
  misc_feature: 77308.UNK.UNK.UNK.pb.heavy.1.raw 77308
ctatgcgcctttgccagcccgctcagacagtatataggaagtagtccttgaccaggcagcccagggccgctgtgctctcgaggtgctcctggagcagggcgccagggggaagaccgatgggcccttgtggaggctgaggagacggtgaccagggctccctggccccagtagaacgatgggctcgtacaataatagagagccgagtcctcggctctcaaattgttcatttgtagatacacggtgttcttggattgtctctggagacggagaatcggcccttcacggagtttccatagtattctttacttccatcagaccagatgactgccacccactccaggcccttgcctggagcctggcggacccagtgcatggcagagtcactgaaactgagtccggacgcaacacaggagagtctcaggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttccctactgactcactaaatcgagcaccgtcgtgtatatactgtctgatggcgcgagggaggcgatacg

SEQ ID NO: 794238 - DNA, 590 bp, Homo sapiens
  misc_feature: 77342.UNK.UNK.UNK.pb.heavy.1.raw 77342
gaaggctgggcaggctatgcaccctggtccaggtcaaaagctgcggaacccgctagcggccatctggcactaggggtcccgcagattcatattgtcgtctagcatgcacaatgctgcaaaccagctgcaatgcccacagcaagcggccaatctttacgcacgttgaattgtttattactgtgactggctatggcttgcaacgccactcgtaaaactagtactttgcggttaggggaagtagacaaacccattactcacttcccggaagttcaaccattccaacacgaaataaaagtaaactcaacaccaagcaggctatgtggggggtgataggggtggattctatttctatccatcccctaggatctcaattaagttactagcgagttaaatgtctgtagcgaatcccgtcagtcctatcgcgcgcatcaagacctgttggttgagcgtgcagtagatcatcgataagctgcgagttagtcatcccagaccgcatctggcgcctaaacgttcagtggtagctaaggcgtcacttcgactgtctaaagcaatatgtcgtccttagctcaagtccctagcaagcgtgtcgg

SEQ ID NO: 794239 - DNA, 692 bp, Homo sapiens
  misc_feature: 77397.UNK.UNK.UNK.pb.heavy.1.raw 77397
ctatgcgcctttgccagcccgcccagacagtatataggaagtagtccttgaccaggcagccagggccgctgtgcccccagaggtgctcttggaggaggtgccaaaggggaagaacgatggcccttggtggaggcggagcgacggtgaccagggttccctggccccagaagtcaaacgaataataaccactccgagcgccgacttgtctcgcacagtaatagacggccgtgtcgtcgcctctcaggttgttcatttgaagataaccgtgttcctgaattgtccctggagatggtgaatcggcccttcacggagtctgcgtagtatgtgaaatcaccagtataatgactgagacccactccagccccttccctgaagcctggcggacccaactcatgtagttgctgctgacgtgagccagaggctgcacaggagagtctctggaccccaggctggactaagcctcctccagactccattcagccgcacctcacactggacaccttttaaaagtcaacaaggagaacccagctcagccaaactccatggtgagtcctctgtgttcagtgctgatcaccgaatggaaacacctcgaatcccagtgctgggctcctctccccaaacccaacgtgcgagtgctaaatcggagcaccggtcgtgtatatactgtctgatggcgcgagggaggcgatacg

SEQ ID NO: 794240 - DNA, 698 bp, Homo sapiens
  misc_feature: 77400.44.55.E11.1.pb.heavy.1.raw 77400
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagctctgggctcaccgtcagcagcaactacatgagttgggtccgccaggctccaggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggccatcgtcttccccctggcaccctcctccaagagcacctctgggggcacagcggccctgggctgcctggtcaaggactacttcctatatactgtctgagcgggctggcaaggcgcatag

SEQ ID NO: 794241 - DNA, 690 bp, Homo sapiens
  misc_feature: 77427.44.74.G08.1.pb.heavy.1.raw 77427
cgtatcgcctccctcgcgccatcagacagtatatacacgaccggtgctcgatttagtagctctatcaggggagcatcacataacaaccacattcctcctctaaagaagccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794242 - DNA, 640 bp, Homo sapiens
  misc_feature: 77487.UNK.UNK.UNK.pb.heavy.1.raw 77487
ccgaccacgcttgctagcgggagcttggagctaaggacgacatattgcctttagacagtcgaaggtgacgccttagctaccactgaacgtttaggcgccagatgcggtcttgggatgacctaaactcgccagcttctttattcgatgattcttactgcacgctcaaccaaccaggtcttgatgcgcgcgataggactgacgggatcgctacagacatttaactcgctagtaacttaattgagatcctaggggatgggataaggaaatagaatccacccctatcaacccccccccccccccccacatagcctgcttggggtgttgagtttacttttatttcgtgttggaatgagttgaacttccgggaagtggagtaatgggtttgtctacttcccctaaccgcaaagtactccagttttacgagtggcgttgcaagccatagccagtcacaggtaataaaacaattcaacgtggcgtaaagattggccgcttgctgtgggcattgcaagctgggtttgcagcattgtgcatgctagacgacaatatgaatctgcgggaacccctaagtgggccaagatggccgctagcggggttccgcagcttttgacctggaccagggtgcatagcctgcccagccttc

SEQ ID NO: 794243 - DNA, 604 bp, Homo sapiens
  misc_feature: 77488.UNK.UNK.UNK.pb.heavy.1.raw 77488
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccggaagtggagtaatgggtttgtctacttccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794244 - DNA, 695 bp, Homo sapiens
  misc_feature: 77511.44.67.G01.1.pb.heavy.1.raw 77511
ctatgcgccttgccagcccgctcagacagtatataggaagtagtccttgaccaggcagcccagggccgctgtgccccagaggtgctcttgaggagggtgccaggggaagaccgatgggccctggtggaggcgaggcgacggtgaccagggttcctggccccagaagtcaaacgaataataaccactccgagcgccgacttgtctcgcacagtaatagacggccgtgtcgtcgcctctcaggttgttcatttgaagataaaccgtgttcctggaattgtcctggagatggtgaatcggcccttcacgagtctgcgtagtatgtgaaaatcaccagtataaatgactgagacccactccagccccttccctggagcctggcggacccaactcatgtagttgctgctgacggtgagccagaggctgcacaggagagtctctgggacccccaggctggactaagctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctggctcctctcccccccaaacccaatatgtatactctaaatcgagcaccggtcgtgtatatactgtctgatgcgcggagggaggcgatacg

SEQ ID NO: 794245 - DNA, 656 bp, Homo sapiens
  misc_feature: 77523.UNK.UNK.UNK.pb.heavy.1.raw 77523
cgtatcgcctccctcgcgccatcagacagtatatacacgacccggtgctcgatttagtaacgttgattagggattgggggctttctgagagtcaagggacctcctgtgcaagaacatgaagcactgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgaccctccgtgaccgccggcggacacggccgtttatttctgtgcgaggcgagactggtctttcaatctatggggccgtggcaccctggtcactgtctcctcagcttccaccaagggcccatcggtcttcccctggcgccctgctcaggagcacctctgggggcacagcggcctgggctgcctggtcaaggactaactttcctagtatactgtctgagcgggctggcaaggcgcatag

SEQ ID NO: 794246 - DNA, 688 bp, Homo sapiens
  misc_feature: 77527.44.72.G06.1.pb.heavy.1.raw 77527
ctatgcgccttgccagcccgctcaggacagtatataggaagtagtccttgaccaggcagcccaggccgctgtgctctcggaggtgctcctggagcagggcgccaggggaagaccgatgggcccttggtggaggctgaggagacggtgaccagggttccctgaccccagtagtcaatgagccacccagcgcctcccgcacaataatacacagccgtgtcctcgactctcagactgttcatttgcagatacagtgagttcttggcgttgtctctggagatggtgaatcggccttcacagagtccacatagtgtgtctcagttccatctttcttcatgatggccacccactccagccccttccctggagcctggcggacccagttcatccaataactactaaaggtgaatccagaggctgcacaggagagtctcaggacccccaggctggaccaagcctccccagactccaccagttgcacctcacactggacaccttctaaaatagcaacaaggaaaacccagctcagtcccaattccatggtgagtcctctgtgctcagtgctgatcaccaagtggaaaggccttggagtccagggctaaggctcctctctcccctttcccttgcagtcgtagctaaatcgagcaccggtcgtgatagtatagactgatggcgcgagggaggcgatacg

SEQ ID NO: 794247 - DNA, 671 bp, Homo sapiens
  misc_feature: 77546.44.45.E01.1.pb.heavy.1.raw 77546
ctatgcgccttgccagccgctcagacagtatataggaagtagtccttgaccaggcagccagggccgctgtgctctcggaggtgctctgagcagggcgccagggggaagaccgatgggcccttggtggaggctgaggagacggtgaccagggctccctggccccagtagaacgatgggctcgtacaatatagagagccgagtcctcggctctcaaattgttcatttgtagatacacggtgttcttggaattgtctctggagacggagaatcggcccttcacggagtttccatagtattcttacttccatcagaccagatgactgccacccactccagccccttgcctggagcctggcggaccagtgcatggcagagtcactgaaactgagtccggacgcaacacagagagtctcagggacgtcccaggctggaccacgcctccccagactcacagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgaggaggcgatacg

SEQ ID NO: 794248 - DNA, 681 bp, Homo sapiens
  misc_feature: 77547.44.73.G07.1.pb.heavy.1.raw 77547
cgtatcgcctccctcgcgccatcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtccctgagactctcctgtgaagcctctggatttagtttcagtagttctggcatgcactggtccgccaggctccaggcaagggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactgggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794249 - DNA, 655 bp, Homo sapiens
  misc_feature: 77556.UNK.UNK.UNK.pb.heavy.1.raw 77556
ccttgccagcccgctcagacagtataataggaagtagtccttgaccaggcagccccgagggcgctgtgcccccagaggtgctcctggagcagggcgccaggggaagaccgatgggcccttggtggaagctgaggaagacagtgcgaccagggtgccacggcccatagattgaaagaccagtctcgcctcgcacagaaataaacggcccgtgtccgcggcggtcacgaggtcagtttcaggagaagcggttcatggacgtgtccctcgaaatggtgagacgactcttgagggacggaggagtagtacgtcgccccagtataatggatgtcaccaatccactccattcccctccctgggggctgccggatccagccccgaagaatgatcagaactgatggaaaactccagagacagtgcagatgagaagacagggttcccccgaaggcctccagttcctggccccgactcctgcagctgcacctgggaacaggaccatctgggagctgccaccagcaggaggaaaaaaccacaggtgcttcatgttcttgcacaggaggtccttgactctcagaagcatcccaaaccaacaatatcgagctaaatcgcagcaccggtcgtgtatatacgtctcgatggccgcgagggaggcgatacg

SEQ ID NO: 794250 - DNA, 697 bp, Homo sapiens
  misc_feature: 77558.UNK.UNK.UNK.pb.heavy.1.raw 77558
cgtatcgcctcctcgcgccatcagacagtatatacacgacggtgctcgatttagagtatacatattgggtttgggggggagaggagcccagcactgggattccgaggtgtttccattcggtgatcagcactgaacacagaggactcaccatggagtttttggctgagctgggttctccttgttggacttttaaaggtgtccagtgtgaggtgcggctgatggagtctggaggaggcttagtccagcctggggggtcccagagactctcctgtgcagcctctgggctcaccgtcagcagcaactacatgagttggtccgccaggctccagggaaggggctggagtgggtctcagtcatttatactggtgatttcacatactacgcagactccgtgaagggcgattcaccatctccagggacaatccaggacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttcccctggcaccctcctccaagagcacctctggggcacagcggccctgggctgcctggtcaaggactacttcctatatactgtctgagcgggctggcaaggcgcatag

SEQ ID NO: 794251 - DNA, 600 bp, Homo sapiens
  misc_feature: 77567.44.36.D03.1.pb.heavy.1.raw 77567
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggacacctccaaaaggcaggtggtctttagtatgaccacatggaccctgcggacacaggcacatattactgtgcacgggtaatgcggaaagaaacagctggtttctgtattatagtcttaccatctggacgtctgggcaaagggaccacggtcaccgtctcctcagcttccaccaagggcccatcggtcttcccctggcgccctgctccaggagcacctctgggggcacagcggccctgggctgcctggtcaagactacttcctatatactgtctgagcgggctgcaaggcgcatag

SEQ ID NO: 794252 - DNA, 705 bp, Homo sapiens
  misc_feature: 77577.44.36.D03.1.pb.heavy.1.raw 77577
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagaagctccccaagagagatcgtgacgcagctaaatcgagcaccggtcgtgtatatactgtctgatggcgcgagggaggcgatacg

SEQ ID NO: 794253 - DNA, 687 bp, Homo sapiens
  misc_feature: 77582.44.73.G07.1.pb.heavy.1.raw 77582
cgtatcgcctccctcgcgccatcagacagtatatacacgaccggtgctcgatttagctctacgctcagggggggagacgagcccagcactggaagtcgccgtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactggtccgccaggctccaggcaagggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagcccctcgagacggtcccgcttgactactggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794254 - DNA, 654 bp, Homo sapiens
  misc_feature: 77592.44.12.B01.1.pb.heavy.1.raw 77592
ctatgcgccttgccagcccgctcagacagtatataggaagtagtccttgaccaggcagcccagggccgctgtgcccagaggtgctcttggaggagggtgccagggaagaccgatgggcccttggtgaggctgaggagacggtgaccagggttccctggccccagtggtcaaagtagtggtgacgaactgccctactctcgcacagtaatacacgcgtgtccgcggcggtcacagagctcagctcagggagaactggttcttggacgtgtctactgatatggtgactcgactcttgagggacgggttgtagtaggtgccccactataatagatactcccaatccactccagccccttccctgggggctggcggatccagccccagtagtaactactactgctgatggagccaccagagacagtgcaggtgagggacagggtctccgaaggcttcaccagtcctggcccgactcctgcagctgcagctgggacaggacccatctgggagccgccaccagcaggaggaagaaccacaggtgcttcatgttcttgcacaggaggtccatgactctcagaaagcccccgcggaatctacactactaaatcgagcaccggtcgtgtatatactgtctgatggcgcgagggaggcgatacg

SEQ ID NO: 794255 - DNA, 591 bp, Homo sapiens
  misc_feature: 77618.44.78.H01.1.pb.heavy.1.raw 77618
ctatgcgccttgccagcccgctcagacagtatataggaagtagtccttgaccaggcagcccagggccgctgtgctctcggaggtgctcctggagcaggcggccaggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttccccccaaacccaaactactcacactaaatcgagcaccggtcgtgtatatactgtctgatggcgcgagggaggcgatacg

SEQ ID NO: 794256 - DNA, 687 bp, Homo sapiens
  misc_feature: 77625.44.62.F07.1.pb.heavy.1.raw 77625
acagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggcccccccagactccaacaactgcacttcacacacgacacccctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 794257 - DNA, 675 bp, Homo sapiens
  misc_feature: 77642.44.6.A06.1.pb.heavy.1.raw 77642
ctatgcgccttgccagcccgctcagacagtatataggaagtagtccttgaccaggcagcccagggccgctgtgccccagaggtgctcctggagcagggcgccaggggaagaccgatgggcccttggtggaagctgaggtgacaatgaccagggttccctgcccccagatctcaaaggctccatgcgagctggggtacggactctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattacacccatccacttcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgtttgctgctgccaccacaaaagaggaacctccaggtccagtccatggtgatgagctgtgctcccaggggcttctttagaggaggaatgtggttgtcagtagatctaaatcgagcaccggtcgtgtatatactgtctgatggcgcgagggaggcgatacg

SEQ ID NO: 794258 - DNA, 698 bp, Homo sapiens
  misc_feature: 77650.UNK.UNK.UNK.pb.heavy.1.raw 77650
cgtatcgcctccctcgcgcgccatcagtctatactatcacgaccggtgctcgattttgatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgcttttatttgggtgcgacaggcccctggacaagggcttgagtggctgggagggatcatccctatctttggtggcatcgaattacgcacagaagtttcaggacagagtcaccattaccggcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccaccaagggcccatcggtcttccccctggcgccctgctccaggagcacctctgggggcacagcggccctgggctggctggtcaaggactacttccctatatactgtctgagcgggctggcaaggcgcatag

SEQ ID NO: 794259 - DNA, 685 bp, Homo sapiens
  misc_feature: 77657.44.27.C05.1.pb.heavy.1.raw 77657
cgtatcgcctccctcgcgccatcagacagtatatacacgaccggtgctcgatttagacgcgatcgaaggtttgggcctgggagacgagcccagcactggaagtcgccggtgtttccactcggtgatcatcactgaacacagaggactccaccatggagtttgggctgagctgggttttcctcgttgccctcttaagaggtgtcatgtgtcaggtgcaattcgtggagtctgggggaggcgtggcccagtaggggggtcctgagactctcctgtgcagcctctggattcaccttcgataattggaatatgcagtgggtccgccaggctccaggcgagggctggagtgggtggcagtgtgtcatttcatggaggaaatcagtctacggtgattccgtgaggccgattcaccatctccagagacaatccgagaacacagtgtctcttcaatgacagcctgagacctcaggacacgccgtgtatttttgtgcgagactatgtttccaaatcggtcattcgacgcctggggccagggaaccctggtcaccgtctcctcggctccaccaaggggccatcggtcttcccctggcgccctgctccaggagcacctccgagagcacagcggccctggctgcctggtcaaggactactcctatatactgtctgagcgggctggcaaggcgcatag

SEQ ID NO: 794260 - DNA, 619 bp, Homo sapiens
  misc_feature: 77660.44.38.D05.1.pb.heavy.1.raw 77660
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtcccttggccccagacgtccataccgtagtagtagtatgcaactccccgaactccccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggacccccaggctgaactaagcctcccccggactccaccagctgcacctcacactggacaccttttaaaatagcaacaaggaaaacccagctatcagatactaaatcgagcaccggtcgtgtatatactgtctgatggcgcgagggaggcgatacg

SEQ ID NO: 794261 - DNA, 733 bp, Homo sapiens
  misc_feature: 77662.UNK.UNK.UNK.pb.heavy.1.raw 77662
ctcatgcgccttgccagcccgctcagagacagtataataggaagtagtccttgaccaggcagcccagggcgctgttgctctcggaggtgctcctggagcagggcggcgcagggggaagaccgatgggcccttggtggaggctgaggagacgggtgaccaggggttccctggccccgaatgaaaccatcccagacagtaatagacggctgtgtcctcggtgttcagggctgttcatctgccagagacaccgtatctttttgaaatcatctcttgagatggtgaatctgcctttcacgggtgcagcgggtagtctgctgtcccaccgtcagctttggttctaatacggccaacccactcccagggcccttccctggagccctggcggacccaggtcatccaggcgttactgaaagtgaatccagggctgcacaggagagtctaagggactccccaggctttaccaaacctcccccagactccaccctgcacctcacactggacacctttaaaattagcagcaggaaaaatccagctcagcccaaactccatggtgagtcctctgtgtcagtcctgatcactgaatgaaaacacctgggacaatcccagcaaactagcggctcctctcccagagccaacactcttctctcaaaaatcgaggccggcatcgttataccgtccgtgtataagactcgatggcgcgagaggaggcagcgatacgggcgggctgaagctg

SEQ ID NO: 794262 - DNA, 574 bp, Homo sapiens
  misc_feature: 77666.44.78.H01.1.pb.heavy.1.raw 77666
ctatgcgccttgccagcccgctcagacagtatataggaagtagtccttgaccaggcagcccagggccgctgtgctcccggaggtggctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtggctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaatcgagcaccggtcgtgtatatactgtctgatggcgcgagggaggcgatacg

SEQ ID NO: 794263 - DNA, 725 bp, Homo sapiens
  misc_feature: 77689.UNK.UNK.UNK.pb.heavy.1.raw 77689
ctatgcgccttgccagcccgctcagacagtatataggaagtagtccttgaccaggcagcccagggccgctgtgctctccggaggtgctcctggagccagggcgccagggggaaagaccgatgggcccttggtggaggccgaggagacggtgaccagggttccctggccccaaggcgtcgaatgaaccgattttggaaacagatagtctcgcacaaaaaatacacggccgtgtcctgaaggtctcaggctgttcattttgaagagacaactgtgttctcggaattgtctctgagaatggtgaatcgccgctcaaccggaatcaccgtagaccttgatttcctccatgaaatgacacacctgccacccactccagccctcgcctggagcctggcggacccactgcatattccaattatcgaaggtgaatccagaggctgcacaggagagtctcagggagaccccctactggggccacgccgccccagactccacgaattgcacctgacacatgacacctcttaagagggcaacgagggaaaacccagcctcagcccaaactccatggtgagtcctctgtgttcagtgatgatcaccgagtggaaacaccggcgattccagtggctgggcctcggtctcccagggctccccaaacccttcgatcggcgtctaaatcgagcaccggtcgtgtatatatactggtctgatggcgcgaggaggcgatacga

SEQ ID NO: 794264 - DNA, 610 bp, Homo sapiens
  misc_feature: 77703.44.36.D03.1.pb.heavy.1.raw 77703
ctatgcgccttgccagcccgctcagacagtatataggaagtagtccttgaccaggcagcccagggccgctgtggccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgtttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgttctgatggcgcgagggaggcgatacg

SEQ ID NO: 794265 - DNA, 645 bp, Homo sapiens
  misc_feature: 77735.UNK.UNK.UNK.pb.heavy.1.raw 77735
ctatgcgccttgccagcccgcctcagacagtatataggaagtagtccttgacaggcagccaggccgctgtgccccagaggtggctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatgtgagacgactcttgagggacgagagtagtacgtcgcccagtataatggatgtcaccaatccactccattcccctccctgggctgccggatccagccccagaatgatcagaactgatggaaactccagagacagtgcagatgagagacagggtttcccgaaggcctcaccagtcctggcccgactcctgcagctgcacctgggacaggacccatctgggagctgccaccagcaggaggaaaaaccacaggtgcttcatgttcttgcacaggaggtccttgactctcagaaagcatccccaaacccaagtctatagcataaatcggagcaccggtcgtgtatatactgtctgatggcgcgagggagcgatacg

SEQ ID NO: 794266 - DNA, 697 bp, Homo sapiens
  misc_feature: 77736.44.55.E11.1.pb.heavy.1.raw 77736
cgtatcgcctccctcgcgccatcagacagtatatcacgaccggtgctcgatttagcactcgcacgttgggtttggggggagaggagcccagcactgggatttccgaggtgtttccattcggtgatcagcactgaacacagaggactccaccatggagttttggctgagctgggttctccttgttggactttaaaaggtgtccaggtgtgaggtgcggctgatggagtctggaggagggcttagtccagctgggggtcccagagactctcctgtggcagcctctggctcaccgtcagcagcaactacatgagttgggtccgccagctccagggaagggctggagtgggtctcagtcatttatactggtgatttcacatactacgcagactccgtgaagggccgattcaccatctccagggacaattccaggaacacggtttatcttcaatgaaacaacctgaagaggcacgacacggccgtctattactgtgcgagacaagtcggcgctcggagtggttattattcgtttgacttctggggccagggaacctggtcccgtcgcctccgcctcaccaagggcccatcggtctttcccctggcaccctcctccagagcacctctgggggcacagcggccctggctgcctggtcaagactacttcctatatactgtctgagcgggctggcaaggcgcatag

SEQ ID NO: 794267 - DNA, 699 bp, Homo sapiens
  misc_feature: 77757.44.27.C05.1.pb.heavy.1.raw 77757
ctatgcgccttgccagcccgctcagacagtatataggaagtagtccttgaccaggcagcccagggccgctgtgctctcggaggtgctcctggagcaggcgccaggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgtttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatttccaattatcgaggtgaatccagaggctgcacaggagagtctcagggacccccctactggggccacgcctccccagactccacgaattgcacctgacacatgacacctcttaagagggcaacgaggaaaacccagctcagccaaaactccatggtgagtcctctgtgttcagtgatgatcaccgagtgggaaacaccggcgacttccagtgctgggctcgtctcccagcccaaacccttcgatcgcgtctaaatcgagcaccggtcgtgtatatactgtctgatggcgcgagggaggcgatacg

SEQ ID NO: 794268 - DNA, 697 bp, Homo sapiens
  misc_feature: 77763.44.55.E11.1.pb.heavy.1.raw 77763
ctatgcgccttgccagcccgctcagacagtatataggaagtagtccttgaccaggcagccagggccgctgtgccccagaggtgctcttggaggagggtgccaggggaagaccgatgggcccttggtggaggcggaggcgacggtgaccagggttccctggcccagaagtcaaacgaataataaccactccgagcgccgacttgtctcgcacagtaatagacgccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaatcgagcaccggtcgtgtatatactgtctgatggcgcgagggaggcgatacg

SEQ ID NO: 794269 - DNA, 721 bp, Homo sapiens
  misc_feature: 77825.44.33.C11.1.pb.heavy.1.raw 77825
cgtatcgcctccctcgcgccatcagacagtatatacacgaccggtgctcgatttagagtgagctcgttgggtttggggctgggagaggagcccagcaccagaagtcgcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatgggctcgtggatacagatatgacatgctctactccaatggtatggacgcctgggccaagggaccacggtcgccgtctcctcagcctccaccaagggcccatcggtcttccccctggcaccctcctccaagagcacctctggggcacagcggccctgggctgcctggtcaaggactgcttcctatatactgtctgagcggctggcaaggcgcatag

SEQ ID NO: 794270 - DNA, 654 bp, Homo sapiens
  misc_feature: 77854.44.53.E09.1.pb.heavy.1.raw 77854
ctatgcgccttgccagcccgctcagacagtatataggaagtagtccttgaccaggcagccccagggccgctgtgctctcggaggtgctcctggagcagggcgccagggggaagaccgatgggcccttggtggaggctgaggatgaggagacggtgaccgtggtcccttggccccagacgtcccaagcgtagtagaattgagacgacctgccataggcggacccatgtctgacacagtagtagacagccgtgtcggcggcggccacagaactcactttcagggaaaactgtgtcctcgacgtgtccacggatatggtgactcgaccgttgagggacgggttgtagtaggtgttcccactataatagagactcccaatccactgcagcccctctcctgggggctggcggatccagccccagtagaaattacttctgtcgatggaggcaccagagaccgtgcacgtgagggacagggtctccgaaggcttcaccagtcctgggccgactcccgcagctgcggctgagacaggacccatctggagccgccaccagcaggaggaagaaccacaggtgcttccccccaaacccaacacactctctctaatcgagcaccggtcgtgtatatactgtctgatggcgcgagggaggcgatacg

SEQ ID NO: 794271 - DNA, 683 bp, Homo sapiens
  misc_feature: 77855.44.45.E01.1.pb.heavy.1.raw 77855
cgtatcgcctccctcgcgccatcagacagttatatacacgaccggtgctcgatttagtgagtcagtaagggaaaggggctgggagaggaggcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcgtcttccccctggcgccctgctccaggagcacctccgagagccagcggccctgggctgcctggtcaaggactacttcctatatactgtctgagcgggctggcaaggcgcatag

SEQ ID NO: 794272 - DNA, 705 bp, Homo sapiens
  misc_feature: 77860.44.67.G01.1.pb.heavy.1.raw 77860
cgtatcgcctcccctcgcgccatcagacagtatatacacgaccggtgctcgatttagagtatacatattgggtttgggggagaggagcccagcactggattccgaggtgtttccatccgggtgatcagcactcgaacacagcaggaactcaccatggagttttggctgagctgggttctccttgtggacttttaaaaggtgtccagtgtgaggtgcgggctgatggagttctggaggaggctagtccagcctggggggtcccagagactctcctgtgcagcctctgggctcaccgtcagcagcaactacatgagttgggtccgccaggctccaggaaggggctggagtgggtctcagtcatttatactgcgtgatttcacatactacgcagactccgtgaaggccgatcacccatctccagggacaattcaggaacacggttatcttcaaatgaacaacctgagaggcgacgacacggccgtctattactgtgcgagacagtcggcgctcggagtggttattattcgtttgacttctggggccagggaaccctggtcaccgtcgcctccgcctccaccaagggcccatcggtcttccccctggcaccctcctccaaagaggcacctctggggggcacagcgccctgggcgcctggtcaaggactacttcctatatactgtctgagcgggctggcaaggcgcatag

SEQ ID NO: 794273 - DNA, 700 bp, Homo sapiens
  misc_feature: 77862.44.36.D03.1.pb.heavy.1.raw 77862
cgtatcgcctccctcgcgccatcagacagtatatacacgaccggtgctcgatttagctgcgtcacgatctctcttggggagctctgagagcggagccccagccccagaattccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaaggcccatcggtcttcccctggcgccctgctccaggagcacctccgagagcacagcggccctgggctgcctggtcaaggactacttcctatatactgtctgagcgggctggcaaggcgcatag

SEQ ID NO: 794274 - DNA, 717 bp, Homo sapiens
  misc_feature: 77885.UNK.UNK.UNK.pb.heavy.1.raw 77885
cgtatcgcctccctcgcgccatcagacagtatatacacgacggtgctcgatttagtgacatctcgcagttctttggggagagacgagccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccgggaggtccctgagactctcctgtgtagcctctgggttctcattcgatagatttggtttgcactgggtccgccaggctccaggcaggggccggagtggtggcagtcatctccgacgatggaagtgagaagtattactcagactccgtgaaggggcgattcaccatctccagagacaattccaagaatatgctgtatttgcaaatgaacagcgtgagagttgacgacacgtctgtttattactgtgcgaggggacctccaaggaaacggttcgggaatcataaactactactatttgatggatgtctgggcaggggacgtcggtcaccgtctcctcagcttccaccaagggcccatcgtcttcccctggcgccctgctccaggagcacctctgggggcacagcggccctgggctgcctggtcaaggactacttcctatatactgtctgagcgggctggcaaggcgcatag

SEQ ID NO: 794275 - DNA, 698 bp, Homo sapiens
  misc_feature: 77897.44.36.D03.1.pb.heavy.1.raw 77897
cgtatcgcctccctcgcgccatcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgctgggttttccttgttgctattttagaaggtgtcactgtgaggtgcggctggtggagtctgggggaggcttggtacagcggggggggtccctgagactctcctgtgcagcctctggattcatcttcagtgactatgccatgaactgggtccgccaggctccagggaagggctggagtgggtttcatatgttaatattgctggagataccacctactacgcagactctgtgaaggccgattcaccaattccaggacaatgccaagaactcactgtatctggaaatgaacagcctgagagacgaggacacggctgtctacttctgttcgagagatcgggcacttggtcagtgctggttttgactactggggccgggaaccctggtcaccgtctctcagcctccaccaagggccatcggtcttcccctggcgcctgctccaggagcacctccgagagcacagcggcctgggctgcctggtcaaggactacttcctatatactgtctgagcgggctggcaagcgcatag

SEQ ID NO: 794276 - DNA, 706 bp, Homo sapiens
  misc_feature: 77900.44.27.C05.1.pb.heavy.1.raw 77900
cgtatcgcctccctcgcgccatcagacagtatatacacgaccggtgctcgatttagacgcgatcgaagggtttgggctgggagacgagcccagcactggaagtcggccggtgtttccactcggtgatcatcactgaaacacagaggactcaccatggagtttgggctgagctggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtggtccgccaggctccaggcgaggggctggagtgggtggcaggtgtgtcatttcatggaggaaatcaagtctacgggtgattccgttgagggccgattcaccatctccagagacaattcccgagaacacagtgtctcttcaaatgaacagccctgagacctcaggacacggccgtgtatttttgttgcgagactatctgtttccaaaatcggttcattcgacgcctggggccagggaaccctggtcaccgtctcctcggcctccaccaaggggcccatcggtcttccccctggcgccctgctccaggagcacctccgagagcacagcggccctgggctgcctggtcaaggactacttcctatatactgtctgagcggctggcaaagcgcatag

SEQ ID NO: 794277 - DNA, 714 bp, Homo sapiens
  misc_feature: 77911.44.85.H08.1.pb.heavy.1.raw 77911
cgtatcgcctccctcgcgccatcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaaagtaataaatactatgcagactccgtgaagggccgattcaccatctccagagacaattccaagaacacgctgtatctgcaaatgaacagcctgagagccgaggacacggctgtgtattactgtgcgaggacatattgtagtactacacctgctgggactactactacggtatggacgtctgggggccaagggaccacggtcaccgtctcctcagcctccaccaagggcccatcggtcttccccctggcaccctcctccaagagcacctctggggcacagcgccctggctgcctggtcaaggactacttcctatatactgtctgagcgggctggcaaggcgcatag

SEQ ID NO: 794278 - DNA, 606 bp, Homo sapiens
  misc_feature: 77934.UNK.UNK.UNK.pb.heavy.1.raw 77934
cccgacacgcttgctagggacttggagctaaggacgacatattggcctttaagacagtcgaaggtgacgccttagctaccactgaacgtttaggcgccagatgcggtctgggatgacctaactcgcagcttatcgatgatctactgcacgctcaaccaccaggtcttgatgcgcgcgataggactgacgggatcgctacagacatttaactcgctagtaacttaattgagatcctaggggatgggataggaaatagaatccaccctatcacccccccacatagcctgcttggggtgttgagtttacttttatttcgtgttggaatgagttgaacttctgggaagtggagtaatgggtttgtctacttccctaaccgcaaagttactagttttacgagtggcgttgcaagccatagccagtcacaggtaataaaacaattcaacgtggcgtaaagattgccgcttgctgtggcattgcaagctgggtttgcagcattgtgcatgctagacgacaatatgaatctgcgggacccctagtggccaagatggcgctagcgggttccgcagcttttgacctggaccagggtgcatagcctgcccagccttc

SEQ ID NO: 794279 - DNA, 670 bp, Homo sapiens
  misc_feature: 77964.44.35.D02.1.pb.heavy.1.raw 77964
ctatgcgccttgccagcccgctcagacagtatataggaagtagtcttgaccaggcagcccaggccgctgtgcccccagaggtgctctgaggagggtgccagggggaagacgatgggcccttggtggaggctgaggagacggtgaccagggttccctggcccaggggtcgagccagttcgccccccgtctctactgtatcgataggaatctctcgcacaataatatacggccgtgtccgcggcggtcacagaagtcaatttcagggagaactggttcttggacctgtctagtgacatggtgactcgactcttgaggcggggttgtagttggtgctgccactgttatagatgcgcccaatccactccagtcccttcccggcggactgccgcagcaactccaataataactactgatgtaaccaccagagacattgcaggtgagggacagggtctccgaagcttcacccgtctgggcccgactcctgcaagctgcacctcggacacgacccatctgggaggttgccaccaggaggaggaagaaccacaggtgttttcatgttcttgtgcaggaggcccatgagtctcagaaagtatccccaaacccactatcgtgtgctaaatcgagcaccggtcgtgtatatactgtctgatggcgcgagggaggcgatacg

SEQ ID NO: 794280 - DNA, 660 bp, Homo sapiens
  misc_feature: 77970.UNK.UNK.UNK.pb.heavy.1.raw 77970
ctatgcgccttgccagcccgctcagacagtatataggaagtagtcttgaccaggcagcccagggccgctgtgctctcggaggtgctcctggagcaggggcgccagggggaagaccgatgggcccttggtggaggctgaggatgagggagcggtgaccgtgggtcccttggccccagacgtcccaagcgtagtagaattgagacgacctgccataggcggaccatgtctgaacacagtagtagacagccgtgtcggcggcggccacagaactcactttcaggaaaactgtgtcctcgacgtgtccacggatatggtgactcgaccgttgagcgacgggttgtagtaggtgttcccactataatagagactcccaatccactgcagccctctcctggggggctggcggatccagccccagtagaattacttctgtcgatggaggccaccagagaccgtgcacgtgagggacagggtctccgaagcttcaccagtcctgggcccgactcccgcagctgcggctgagacaggacccatctgggagccgccacccagcaggaggcaagaaacacaggtgcttcccccccaaacccaacacactctcttacaatcgagcacgcgtcgtggtatatactgtctgatggcgcgagggaggcgatgacg

SEQ ID NO: 794281 - DNA, 701 bp, Homo sapiens
  misc_feature: 77985.44.74.G08.1.pb.heavy.1.raw 77985
cgtatcgcctccctcgcgccatcagacagtatatatacacgaccggtgctcgatttagtagctctatcaggggggaagcatcacataacaaccacattcctcctctaaagaagcccctgggagcacagctcatcaccatggactggacctggaggttcctctttgtggtggcagcagcaacaggtgtccagtccctggtgcaactggtgcagtctgggagactagaatgccgcaaccttggtcctcggtgaccctttcctgcacggcctctggaagtactaccagttccactacttataccatcaactggggtgcggccaggcccctggacagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcactcagcttccaccaagggcccatcggtcttccgcctggcgccctgctccaggagcacctctggggcacagcggccctggggctgcctggtcaaggactacttcctatatactgtctgagccgggctggcaaggcgcatag

SEQ ID NO: 794282 - DNA, 682 bp, Homo sapiens
  misc_feature: 77995.44.38.D05.1.pb.heavy.1.raw 77995
cgtatcgcctccctcgcgccatcagacagtatatacacgaccggtgctcgatttagtatctgatagttgggtttggggggaagaggaaagactgacggtcctcccaggagttcaggtgctgggcaccttgggtacgggggaggtgtgtcacaagatttgggctctgggcaccgtggggcatggggaggcttagttcagcctggggggtccctgagactctcctgtgcagcctctggattcaccttcagtagctactggatgcactgggtccgccaagctccagggaagggctggtggtgggtctcacgtatttaatagtgatgggagtagcacaagctacgcggactcccgtgaagggccgatttcaccatctccagagaacaacgccaagaacacgctgtatctgcaaatgaacagtctgagaagccgaggacacggctgtgtattactgtgcaagagcccggtgcgggagttcggggagttgcatactactactacggtatggaccgtctggggccaagggaccacggtcaccgtctcctcagcttccaccaagggcccatcggtcttcccccctggcgccctgctccaggagcacctctggggggcacagcggccctgggctgcctggtcaaggactactttcctatatactgtctgagcgggctggcaaggcgcatag

SEQ ID NO: 794283 - DNA, 705 bp, Homo sapiens; identical to SEQ ID NO: 790895
  misc_feature: 78005.44.36.D03.1.pb.heavy.1.raw 78005

SEQ ID NO: 794284 - DNA, 690 bp, Homo sapiens
  misc_feature: 78010.44.56.F01.1.pb.heavy.1.raw 78010
cgtatcgcctccctcgcgccatcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagtttttttagaaggtgtccagtgcgagggcgactggcggagtcggggggggcttggcacagccagggcggtctctgagactctcctgtgtagtctcaggattcagtcttagtgattatcacttggcctgggtccgtcaggctccagggaagggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctggacgtcgatgcatttgatatttggggccaggggacaatggtcaccgtctcttcagcttccaccaagggcccatcggtcttccccctggcgccctgctccaggagcacctctggggcacagcggccctgggctgcctggtcaaggactacttcctatatactgtctgagcggg

SEQ ID NO: 794285 - DNA, 703 bp, Homo sapiens
  misc_feature: 78017.44.55.E11.1.pb.heavy.1.raw 78017
ctatgcgccttgccagcccgctcagacagtaggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaaccccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 794286 - DNA, 694 bp, Homo sapiens
  misc_feature: 78027.44.45.E01.1.pb.heavy.1.raw 78027
ctatgcgccttgcccagcccgctcagacagtattataggaagtagtccttgaccaggcagcccagggccgctgtgctctcggaggtgctcctggagcaggggcgccaggggggaagaccgatgggcccttggtggaggctgaggagacggtgaccagggctcctggccccagtagaacgatggggctcgtacaataatagagagccgagtcctcggctctcaaattgttcatttgtagatacacggtgttcttggaattgtctctggagacgggagaatcggcccttcacggagtttccatagtattctttacttccatcagaccagatgactgccacccactccagccccttgcctggagcctggcggacccagtgcatggcagagtcactgaaaactgagtccggacgcaaaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaaacaccgccgacttctagtgctgggctcctcctcccagcccctttcccttactgactcactaaatcgagcaccggtcgtgtatatactgtctgatggcgccgagggaggcgatacg

SEQ ID NO: 794287 - DNA, 716 bp, Homo sapiens
  misc_feature: 78035.UNK.UNK.UNK.pb.heavy.1.raw 78035
ctatgcgccttgccagcccgctcagacagtatataggaagtagtccttgaccaggcagcccagggcccgctgtgccccagaggtgctctttggaggagggtgccaggggaagaccgatggcccttggtggaggcggaggcgacggtgaccagggttccctggccccagaagtccaaacgaataataaccactccgagcgccgacttgttctcgcacagtaatagacggccgtgtcgtcgcctctcaggttgttcatttgagataaaccgtgttcctggaattgtccctggagatggtgaatcgggcccttcacggagtctgcgtagtatgtgaaatcaccagtataaatgactgagacccactccagccccttcctgggagcctgggcgggacccaactcattgtagttgctgctgacggtgagcccagaaggctgcacaggagagtctctgggacccccaaggcctggactaagcctcctccaggactccattcagccgcacctcacactggacacctttaaaagtccaacaaggaagaacccagctcagccaaaactccatggtgagtcctctgtgttcagtgctgatcaccgaatggaaacacctcgaatcccagttgctgggctcctctccccccccaaacccaacgtgcgagtgctaaatcgagcaccggtcgttgtatatactgtctgatggcgcgagggaggcgatacg

SEQ ID NO: 794288 - DNA, 680 bp, Homo sapiens
  misc_feature: 78041.UNK.UNK.UNK.pb.heavy.1.raw 78041
cgtatcgcctccctcgccgccatcagacagtatatacacgaccggtggctcgatttagtagtgtagattccgcgggggcttttctgagagtcatggacctcctgtgcaagaacatgaagcacctgtggttctttcctcctgctggtggcggctcccagatgggtcctgtccccagctgcagctgcaggagtcgggcccaggactggtgaagccttcggagaccctgtccctcacctgccactgtctctggtgggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtaattactgtgcgagagtagggcagttcgtcaccaactactttgaccacttggggccagggaaaccctggtcaccgtctcctcagccctccaccaaggggccccatcggtcttcccccctgggcaccctcctccaagagcacctctgggggcacagcggccctgggctgcctggtcaaggactacttcctatatactgtctgagcgggctggcaaggcgcatag

SEQ ID NO: 794289 - DNA, 673 bp, Homo sapiens
  misc_feature: 78048.44.45.E01.1.pb.heavy.1.raw 78048
ctatgcgccttgccagccgctcagacagtatataggaagtagtccttgaccaggcagcccaggccgctgtgctctcggaggtgctcctggagcagggcgccaggggaagacgatgggccttggtggaggctgaggagacggtgaccaggggtccctggccccagtagaacgatgggctcgtacaataatagagagccgagtctcggctctcaaattgttcatttgtagatacacggtgttcttggaattgtctctggagacggagaatcggcccttcacggagtttccatagtattcttacttccatcagaccagatgactgccacccactccagccccttgcctggagcctggcggaccagtgcatggcagagtcactgaaaactgagtccggacgcaacacaggagagtccaggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagccctttcccttactgactcactaaatcgagcaccggtcgtgtatatactgtctgatggcggcgagggaggcgatacg

SEQ ID NO: 794290 - DNA, 695 bp, Homo sapiens
  misc_feature: 78059.UNK.UNK.UNK.pb.heavy.1.raw 78059
ccttgccagccgctcagacagtatataggaagtagtccttgaccaggcagcccagggccgctgtgcccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgttaaatcgagcaccggtcgtgtatatactgtctgatggcgcgagggaggcgatacg

SEQ ID NO: 794291 - DNA, 646 bp, Homo sapiens
  misc_feature: 78081.44.86.H09.1.pb.heavy.1.raw 78081
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccaccggcccatagattgaaagaccagtctcgcctcgcacagaaataaacggccgtgtccgcggcgtcacggaggtcagtttcagggagaagcggttcatggacgtgtccctcgaaatggtgagacgactcttgaggacggagagtagtacgtcgcccagtataatggatgtcaccaatcactccattcccctccctgggggctgccggatccagcccaagaatgatcagaactgatggaaactccagagacagtgcagatgagagacagggttcccgaaggcctcaccagtctgggcccgactcctgcagctgcacctgggacaggacccatctgggagctgccaccagcaggaggaaaaaaccacaggtgcttcatgttctgcacaggagtccttgactctcagaaagcatccccaaacccaagtctatagcactaaatcgagcaccggtcgtgtatatactgtctgatgcgcgagggaggcgatacg

SEQ ID NO: 794292 - DNA, 689 bp, Homo sapiens
  misc_feature: 78088.44.35.D02.1.pb.heavy.1.raw 78088
cgtatcgcctccctcctcgcgccatcaggacagtatatacacgaccggtgctcgatttagcacacgatagttgggttttggggatactttctgagaactcatgggcctcctgcacaagaacatgaaacacctgtggttcttcctcctcctggttggcacctcccagatgggtcgtgtccgaggtgcagctgcaggagtcgggcccaggacgggtgaagccttcggagaccctgtccctcacctgcaatgtctctggtggttacatcagtagtttattattggagttggctgcggcagtccgccgggaagggactggagtggattgggcgcatctataacagtggcagcaccaactacaaacccgccctcaagagtcgagtcaccatgtcactagacaggtccaagaaccagttttctccctgaaattgacttctgtgaccgccgcggacacgccgtatattattgtgcgagagattcctatcgatacagtagagacggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactactgtcctatatactgtcttgagcgggctggcaaggcgcatag

SEQ ID NO: 794293 - DNA, 649 bp, Homo sapiens
  misc_feature: 78097.UNK.UNK.UNK.pb.heavy.1.raw 78097
ctatgcgccttgccagcccgctcagacagtatataggaagtagtccttgaccaggcagcccagggccgctgtgccccagaggtgctcctggagcagggcgccagggggaagaccgatgggccttggtggaagctgaggagacagtgaccaggtgccacggccccatagattgaaagacagtctcgcctcgcacagaaataaacgggccgtgtccgcggcggtcacggaggtccagttttcagggagaagcggttcatggacgtgtcctcgaaatggtgagacgactcttgaggacggagagtagtacgtcgccccagtataatggatgtcaccaatcactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcccccaatccctaatcacgtgtactaaatagagcaccggtcgtgtatatactgtctgatggcgcgagggaggcgatacg

SEQ ID NO: 794294 - DNA, 651 bp, Homo sapiens
  misc_feature: 78101.44.86.H09.1.pb.heavy.1.raw 78101
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggaccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 794295 - DNA, 704 bp, Homo sapiens
  misc_feature: 78111.44.36.D03.1.pb.heavy.1.raw 78111
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 794296 - DNA, 702 bp, Homo sapiens
  misc_feature: 78112.44.55.E11.1.pb.heavy.1.raw 78112
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaatgaacacctgagaggcgacgacacggccgtctattactgtgcgagacaagtcggcgctcggagtggttattattcgtttgacttctggggccagggaaccctggtcaccgtcgcctccgcctccacaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794297 - DNA, 613 bp, Homo sapiens
  misc_feature: 78123.44.27.C05.1.pb.heavy.1.raw 78123
ctatgcgccttgccagcccgctcagacagtatataggaagtagtccttgaccaggcagcccagggccgctgtgctctcggaggtgctcctggagcagggcgccaggggaaagaccgatgggcccttggtggaggccgaggagacggtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactgggccacgcctcccccagactccacgaattgcacctgacacatgacacctcttaagagggcaacgaggaaaacccagctcagcccaaacccttcgatcgcgtctaaatcgagcaccggtcgtgtatatactgtctgatggcgcgaggaggcgatacg

SEQ ID NO: 794298 - DNA, 702 bp, Homo sapiens
  misc_feature: 78125.44.27.C05.1.pb.heavy.1.raw 78125
ctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagccctcgcctggagcctggcggaccactgcatattccaattatcgaaggtgaatccagaggctgcacaggagagtctcagggaccccctactggggccacgcctccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagcccccaaacccttcgatcgcgtctaaatcgagcaccggtcgtgtatatactgtctgatggcgcgcgagggagcgatacg

SEQ ID NO: 794299 - DNA, 717 bp, Homo sapiens
  misc_feature: 78129.44.85.H08.1.pb.heavy.1.raw 78129
cgtatcgcctccctcgcgccatcagacagtatatacacgaccggtgctcgatttagtatcactcagtcgcggggagctctgggagaggagcccagcactagaagtcggcggtgttccattcggtgatcagcactgaacacagaggactcaccatggagtttggctgagctggttttcctcgttgctcttttaagaggtgtccagtgtcaggtgcagctgggtggagtctggggaggcgtggtccagcctgggaggtccctgagactctcctgtgcagcgtctggattcaccttcagtacctatggcatgcactgggtccgccaggctccaggcaagggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794300 - DNA, 589 bp, Homo sapiens
  misc_feature: 78144.44.78.H01.1.pb.heavy.1.raw 78144
ctatgcgccttgccagcccgctcagacagtatatagggaagtagtccttgaccaggcagcccagggccgctgtgctctcggaggtgctcctgggcagggcgccagggggaagaccgatgggcccttggtggaggctgaggagacggtgaccagggttccctggccccacaagtcagccaggtgctggtggctctcgcacagaaatacacggccgtgtcctcagatctcaggctgctcagttccatgtagactgtacctggggaggtgctcctggtcatactaactctgccttggaacttctgggcaaagccgtgttgccactataggggcttcatccatcccatccactccagcccttgtccagcggcctgtcgcacccagttaatatcataattgatgaacgtgtatccagaagccgtgcaggagactgtcactgaggcccaggcttcttcacctcagccccagactgcacagcctgtacctgggagtgggaccgtcagtcttcctcttcccccaaacccaaactactcacactaaatcgagcaccggtcgtgtatatactgtctgatggcgcgagggaggcgatacg

SEQ ID NO: 794301 - DNA, 585 bp, Homo sapiens
  misc_feature: 78149.44.78.H01.1.pb.heavy.1.raw 78149
cgtatcgcctcctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgacaggagcacctcccaggtacagtctacatggaactgagcagcctgagatctgaggacacggccgtgtatttctgtgcgagagccacagcacctggcttgacttgtggggccaggaaccctggtcaccgtctcctcagcctccaccaagggcccatcggtcttcccctggcgccctgctccaggagcacctccgagagcacagcggccctgggctgcctgtcaaggactacttcctatatactgtctgagcgggctggcaaggcgcatag

SEQ ID NO: 794302 - DNA, 705 bp, Homo sapiens
  misc_feature: 78163.44.73.G07.1.pb.heavy.1.raw 78163
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtagtcaagccggggaccgtctcgaggggggctctcgcacaataatagacagccgtgtcctcacttgtgaggttgtacattttgcagatgcagtgtgttcctggaattggtctctggagacggtgaatcggcccttctcggagtcctccgtagtgttcttcaattccatcttctgatataattgccacccgcactccagcccttgcctggagccctggcggacccagtgcatggcataggtccctgaagatgaattccagagctgcacaggagagtctcagggagttccaggctgggccgctcctcccccagactccactagctgcacctgacactggccacctcttaaaagagcaacgaggaaaaacccatctcagcccaaagtccatgtgagtcctctgtgttcagtgatgatcccaccgaatggaaacaccggcgacttccagtgctgggctcgtctccccccctgagcgtagagctaatcgagcaccggtcgtgtatacttactgtctgatggcgcgacagggaggcgatacg

SEQ ID NO: 794303 - DNA, 668 bp, Homo sapiens
  misc_feature: 78171.UNK.UNK.UNK.pb.heavy.1.raw 78171
cgtatcgcctccccctcgccgccatcagaccagtatatacacgaccgggtgctcgatttagagagagtgtgttgggttttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaacccgtccctcaacggtcgagtcaccatatccgtggacacgtcgaggacacagttttttccctgacaagtgagttctgtggcccgccgccgacacggctgtctactactgtgttcagacatgggtccgcctatggcaggtcgtcctcaattctactacgcttgggacgtctggggggccaagggaccacggtcaccgtctcctcatcctcagccttccaccaaagggcccatcggtcttccccctggcgcctgcttccaggagcacctccgagagcacagcgggccctgggctgccttggtcaaggactacttcctatatactgtctgagcgggctggcaaggc

SEQ ID NO: 794304 - DNA, 550 bp, Homo sapiens
  misc_feature: 78194.44.43.D10.1.pb.heavy.1.raw 78194
ctatgcgccttgccagccccgctcagacagtatataggaagtagtccttgaccaggcagcccagggccgctgtgccccagaggtgctcctggagcagggcgccagggggaagaccgatgggcccttggtggaagctgaggagacggtgaccagggttccctggccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggccccaggcttcttcacctcagccccttactgctagtctaaatcgagcaccggtcgtgtatatactgtctgatggcgcgagggaggcgatacg

SEQ ID NO: 794305 - DNA, 681 bp, Homo sapiens
  misc_feature: 78210.44.45.E01.1.pb.heavy.1.raw 78210
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggccttcacggagtttccatagtattctttacttccatcagaccagatgactgccaccccactccagccccttgcctggagcctggcggacccagtgcatggcagagtcactgaaactgagtccggacgcaacacaggagagtctcagaggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctctctcccagccctttccttactgactcactaaatcgagcaccggtcgtgtatatactgtctgatggcgcgagggaggcgatacg

SEQ ID NO: 794306 - DNA, 710 bp, Homo sapiens
  misc_feature: 78211.UNK.UNK.UNK.pb.heavy.1.raw 78211
ctatgcgccttgccagcccgctcagacatatataggaagtagtccttgacaggcagcccagggccgctgtgcccccagaggtgctcttggagtagggtgccagggggaagaccgatgggcccttggtggaggcggaggcggacggtgaccagggttccctggccccagaagtcaaacgaataataaccactccgagcgccgacttgtctcgcacagtaatagacggcggtgtcgtcgcctctcaggttgttcatttgaagataaaccgtgttcctggaattgtccctggagatggtgaatcggcccttcacggagtctgcgtagtatgtgaatcaccagtataaatgactgagacccactccagccccttccctggagcctggcggacccaactcttgtagttgctgctgacgcggtgagcccagcaggctgcaacaggagagtctctggaccccccaggctggactaagcctcctccagactccatcagccgcacctcacactggacaccctttttaaaagtccaacaaggagaacccagctcagccaaaactccatggtgagtcctctgtgttcagtgctgatcaccgaatggaaacacctcggaatcccagtgctgggctcctctccccccaaacccaacgtgcgagtgctaaaatcgagcacccggtcgtgtatatactgtctgatggcgcgagggaggcgatacg

SEQ ID NO: 794307 - DNA, 654 bp, Homo sapiens
  misc_feature: 78214.44.86.H09.1.pb.heavy.1.raw 78214
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794308 - DNA, 697 bp, Homo sapiens
  misc_feature: 78224.44.55.E11.1.pb.heavy.1.raw 78224
cgtatcgcctccctcgcgccatcagacagtatatacacgaccggtgctcgatttagcactcgcacgttgggtttggggagaggagccagcactgggattccgaggtgttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccaggaaggggcttggagtgggtctcagtcatttatactggtgatttcacatactacgcagactccgtgaaggccgattcaccatctccagggacaattccaggaacacggtttatcttcaaatgaacaacctgagaggcgacgacacggccgtctattactgtgcgagacaagtcgcgctcggagtggttattattcgtttgacttctggggcagggaaccctggtcaccgtcgcctccgcctccaccaagggcccatcggtcttccccctggcaccctcctccaagagcacctctgggggcacagcggccctgggctgcctggtcaaggactacttcctatatactgtctgagcggctggcaaggcgcatag

SEQ ID NO: 794309 - DNA, 712 bp, Homo sapiens
  misc_feature: 78225.UNK.UNK.UNK.pb.heavy.1.raw 78225
ctatgcgccttgccagcccgctcagacagtatataggaagtagtccttgaccaggcagcccagggccgctgtgctctcggaggtggctcctggagcagggcgccagggggaagaccgatgggcccttggtggaggctgaggagacggtgaccagggttccccggccccagtagtcaaaaccagccactgaccaagtggcccgatctctcgaacagaagtagacagcggtcgtcctcgtctctcaggctgttcattccagatacagtgagttcttggcatgtgtccctggattggtgaatcggcccttcacagagtctgcggtagtaggtggtatctccagcaatattacatatgaaacccactccagccccttccctggagcctggcggacccagtcatggcatagtccactgaagatgaatccagaggctgcacaggagagtctcagggaccacccccccgctgtaccagcctcccccagactccaccagccgcacctcacagtggacaccttctaaatagccaacaaggaaaacccaggcgcagcccaactccatggtgagtcctctgtgttcattgctgatcaccaagtggaaatgccttggaatccagggctaaggcacctctctgagagctccaagagagatcgtgacgccagctaaatcgagcaccgtcgtgtatatactgtctgatggcgcgaggaggcgatacg

SEQ ID NO: 794310 - DNA, 698 bp, Homo sapiens
  misc_feature: 78238.44.36.D03.1.pb.heavy.1.raw 78238
ctatgcgccttgccagcccgctcagacagtatataggaagtagtccttgaccaggcagcccagggccgctgtgctctcggaggtgctcctggagcagggcgccagggaagaccgatggccctggtggaggctgaggaacggtgaccagggttccctgcccagtggacagttcctgatataaacacaacacaaataatacatgcccgtgtcctcggttttcaggttagtcattcgcagaatcaatgagttcttgaagtcatctcttgagagggtgaattctggctttcacagacgcggcgtactctgtgataaagctgcaactttgtttttactgcggccaagccactccagccccttccctggagcctggcggaacccagtccatatagtggtcactgatggtgaatccagaggcgacacaggagagtctcaggaccctccaggctggaccaagtctcccccggactcaccaactgcacttcactctggacaccttgtaaaatacaacaaggaaaacccagctcagcccgaactccatggtgagtcctctgtgtttcagtgctgatcaccaaatgaaaacacctgggaaattctggggctggggctcgctctcagagctcccaagagagatcgtgacgcagctaaaatcgagcaccggtcgtgtatatactgtctgatggcgcgagggaggcgatacg

SEQ ID NO: 794311 - DNA, 684 bp, Homo sapiens
  misc_feature: 78240.UNK.UNK.UNK.pb.heavy.1.raw 78240
cgtatcgcctccctcgcgccatcagaacagtatatacacgaacggtgggctcgatttagtagtgtaagaattccgcggggctttctgagagtcatggacctcctgtgcaagaaacatggaagcacctgtggttcttccctccctgcttggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggatgggagtatctattatagtggggagcacctactacaaacccgtccctcaagagtcgagtcacccatatcagtagaacacgtccaagaaccagttctccctgaagctgagctctggtgaccgccgcggacacggccgtgtattactgtgcgagagtagggcagttcgtcaccaactaactttgaccactggggccagggaaccctggtcaccgtctcctcagcctccaccaagggccccatcggtcttcccctgggcaccctcctccaagagcaccttctgggggcacagcggccctggggcctgcctggtcaaggaactacttcctatatactgtctgagcgggctggcaaggcgcatag

SEQ ID NO: 794312 - DNA, 705 bp, Homo sapiens
  misc_feature: 78254.UNK.UNK.UNK.pb.heavy.1.raw 78254
cgtatcgcctcccctcgcgccatcagaccagtatatacacgaccggtgctcgatttagctgcgtccacgatctctcttggggagctctgagagcggagccccagccccagaattcccaggtgttttcatttgtgatcagcactgaacacagaggactcaccatggagttcggctgagctgggttttccttgttgttattttacaaggtgtccagagtgaagtgcagttggtgggagtccgggggagacttggtccagcctggagggtcctgagactctcctgtgtcgcctctggattcaccatcagtgaccactatatggactgggtccgccaggctccagggaaggggcctggagtggctttggccgcagtaaaaacaaagttgccagctttatcacagagtacgccgcgtctgtgaaagccagattcaccctctcaagagatgacttcaagactcattgattctgcgaatgactaacctgaaaaacgaggacacgggcatgtattattgtgtgtgtttatatcaggaactgtccactgggccagggaaccctggtcaccgtctcctcagcctccaccaagggcccatcggtctccgccctggcgcctgctccaggagcacctccgagagcacagcggccctggggctgcctggtcaaggactacttcctatatactgtctgagcgggctggcaaggcgcatag

SEQ ID NO: 794313 - DNA, 666 bp, Homo sapiens
  misc_feature: 78256.44.12.B01.1.pb.heavy.1.raw 78256
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttggaccactggggccagggaaccctggtcaccgtctcctccagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794314 - DNA, 669 bp, Homo sapiens
  misc_feature: 78258.44.86.H09.1.pb.heavy.1.raw 78258
cgtatcgcctcctcgcgccatcagacagtatatacacgaccggtgctcgatttagtgctatagactttggggtttgggggatgctttctgaagagtcaaggacctcctgtgcaagaacatgaaagcacctgtggtttttcctcctgctggtggcagcctcccagatgggtcctgttccccaggtgcagctgcaggagtcgggcccaggactggtgaggcccttcgggaaccctgtctctcatctgcactgtctctggagtttccatcagttctgaatcattcttggggctggatccggcagcccccagggaggggaatgggagtggattggtgacatccattatactggggcgacgtactactctccgtccctcaagagtcgtctcaccatttcgagggacacgtccatgaaccgctttctccctgaaactgacctccgtgaccgccgcggacacggccgttttattctgtgcgaggcgagactggtctttcaatctatggggccgtggcaccctggtcactgtctccttcagcttccaccaagggcccatcggtcttccccctggcgcccttgcctccaggagcacctctgggggcacagcggccctgggctgcctggtcaaggactacttcctatatactgtctgagcgggctggcaaggcgcatag

SEQ ID NO: 794315 - DNA, 550 bp, Homo sapiens
  misc_feature: 78276.UNK.UNK.UNK.pb.heavy.1.raw 78276
cgtatcgcctccctcgcgccatcagacagtatatacacgaccggtgctcggatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgaccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794316 - DNA, 712 bp, Homo sapiens
  misc_feature: 78293.UNK.UNK.UNK.pb.heavy.1.raw 78293
cgtatcgcctccctcgcgccatcagacagtatatacacgaccggtgctcgatttagcactcgccacgttgggtttggggggagaggagcccagcactgggattccgaggtgttccattcggtgatcagcactgaacacagaggactcaccatggagtttggctgagctgggttctccttgttggacttttaaaaggtgtccagtgtgaggtgcggctgatggagtctggaggaggcttagtccccagctggggggtttccagagactctcctgtggcagcctctgggctcaccgtcagcagcaactacatggttgggtccgccaggctccagggaaggggctggagtgggtctcagtcattatactggtgatttcacatactacgcagactccgtgaagggccgattcaccatctccagggaccaattccagggaacacggtttatcttcaaatgaacaacctgagaggcgacgacacggccgtctattactgtgcggagacaagtcggcgctcggagtggttattattcgttttgacttctggggccagggaaccctggtcaccgtcgcctccgcctccaccaagggcccatcggtccttccccctggcaccctcctccaaagagcacctctgggggcacagcggccctgggctgcctggtcaaggactactttcctatatactgtctgagcgggctggcaaggcgcatag

SEQ ID NO: 794317 - DNA, 702 bp, Homo sapiens
  misc_feature: 78300.44.55.E11.1.pb.heavy.1.raw 78300
ctatgcgccttgccagcccgctcagacagtatataggaagtagtccttgaccaggcagcccagggccgctgtgcccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggaccccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatccagtgctgggctcctctccccaaacccaacgtgcgagtgctaaatcgagcaccggtcgtgtatatactgtctgatggcgcgagggaggcgatacg

SEQ ID NO: 794318 - DNA, 707 bp, Homo sapiens
  misc_feature: 78304.UNK.UNK.UNK.pb.heavy.1.raw 78304
ctatgcgccttgccagccgctcagacagtatataggaagtagtccttgaccaggcagcccagggccgctgtgctctcggaagtgctcctggagcagggcgccagggggagacagatgggcccttggtggaggccgaggagacggtgaccagggttccctggccccaggcgtcgaatgaaccggattttgaaacagatagtctcgcacaaaaatacacggccgtgtcctgaggtctcaggctgttcatttgaagagacactgtgttctcggaattgtcctctggagatggtgaatcggccctcaacggaatcaccgtagacttgatttcctccatgaaatgacacaacctgccacccactccagcccctcgcctggagcctggcggacccactgcatattccaattatcgaaggtgaatccagaggctgcacaggagagtctcaggacccccctactggggccacgcctcccccagactccacggaattgcacctgacaatgacacctcttaagagggcaacgagggaaaacccagctcagccaaactcccatggtgagtcctctgtgttcagttgatgatcaccgagtggaaacaccggcgacttccagtgctgggctcgtctcccaggccccaaacccttcgatcgcgtctaaatcgagcaccggtccgtgtatatactgtctgatggcgcgagggaggcgatacg

SEQ ID NO: 794319 - DNA, 695 bp, Homo sapiens
  misc_feature: 78305.44.36.D03.1.pb.heavy.1.raw 78305
cggtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcacatcagtgaccactatatggactgggtccgccaggctccaggaaggggctggagtggcttggtcgcagtaaaaacaaagttgccagctttatcacagagtacgccgcgtctgtgaaagccagattcaccctcttcaagagatgacttcaagaactcattgatttctgcgaatgactaacctgaaaaccgaggacacgggcatgtattattgtgttgtgtttatatcaggaactgtccactgggccagggaaccctggtcaccgtctcctcagcctccaccagggcccatcgtcttcccctggcgccctgctccaggagacctccgagagcacagcggcctgggctgcctgtcaagactacttctatatactgtctgagcgggctggcaaggcgcatag

SEQ ID NO: 794320 - DNA, 650 bp, Homo sapiens
  misc_feature: 78309.44.86.H09.1.pb.heavy.1.raw 78309
ctatgcgccttgccagcccgctcagacagtatataggaagtagtccttgaccaggcagcccagggccgctgtgccccagaggtgctcctggagcagggcgccagggggaagaccgatggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgaggacggagagtagtacgtcgccccagtataatggatgtcacaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 794321 - DNA, 701 bp, Homo sapiens
  misc_feature: 78322.UNK.UNK.UNK.pb.heavy.1.raw 78322
cgtatcgcctccctcgcgccatcagacagtatatacacgacgcggtgctcgatttagctgcgtcacgatctctcttggggagctctgagagcggagcccccagccccagaattccaggtgttttcatttggtgatcagcactgaacaccagaggactcaccatggagttcgggctgagctgggttttccttgttgttattttacaaggtgtccagagtgaagtgcagttggtggagtccggggagactggtccagcctggagggtccctgagactctcctgtgtcgcctctggattcaccatcagtgaccactatatggactgggtccgccagctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaccgaggacacggcatgtattattgtgttgtgttatatcaggaactgtccactgggcccagggaaccctggtcaccgtctcctcagcctccaccaagggccccatcggtcttccccctggcgccctgctccaggagcacctccgagagcacagcggcctgggctgcctggtcaaggactacttcctatatactgtctgagcgggctggcaaggcgcatag

SEQ ID NO: 794322 - DNA, 695 bp, Homo sapiens
  misc_feature: 78332.44.55.E11.1.pb.heavy.1.raw 78332
ctatgcgccttgccagcccgctcagacagtatataggaagtagtcttgaccaggcagcccagggccgctgtgcccccagaggtgctcttggaggagggtgccagggggaagaccgatgggccttgtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccctgtcctgcgaattgtccctggagatggtgaatcggcccttcacggagtctgcgtagtatgtgaaatcaccagtataaatgactgagacccactccagcccttccctggagcctggcgacccaactcatgtagttgctgcctgacggtgagcccagaggctgcacaggagagtctctgggaccccccaggctgactaagcctcctccagactccatcaggccgcacctcacactggacaccttttaaaagtccacaaggagaacccagctcagccaaaactcatggtgagtcctctgtgttcagtgctgatcacgaatggaaaacaccgtcgaatcccagtgctgggctctctcccaaacccaacgtgcgagtgctaaatcgagcaccggtcgtgatagtatagactgatggcgcgagggaggcgatacg

SEQ ID NO: 794323 - DNA, 701 bp, Homo sapiens
  misc_feature: 78334.UNK.UNK.UNK.pb.heavy.1.raw 78334
cgtatcgcctccctcgcgccatcagacagtatatacacgaccgtgtgctcgattagagtatacatattgggtttggggggagaggagcccagcactgggattccgaggtgtttccattcggtgatcagcactgaacacagaggactcaccatggagtttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtggcgagacaagtcggcgctcggagtggttattattcgtttgacttctggggccaggaaccctggtcaccgtcgcctccgcctccaccaagggcccatcggtcttccctggcaccctcctccaagagcacctctgggggcacagcggccctggctgcctggtcaaggactacttcctatatactgtctgagcgggctggcaaggcgcatag

SEQ ID NO: 794324 - DNA, 701 bp, Homo sapiens
  misc_feature: 78341.44.55.E11.1.pb.heavy.1.raw 78341
ctatgcgccttgccagcccgctcagacagtatataggaagtagtccttgaccaggcagcccagggccgctgtgcccccagaggtgctcttggaggaggggtgccagggggaagaccgatgggcccttggtggaggcggaggcgacggtgaccagggttccctggccccagaagtcaaacgaataataaccactccgagcgccgacttgtctcgcacagtaataggacggccgtgtcgtcgcctctcaggttgttcatttgaagataaaccgtgttcctggaattgtccctggagatggtgaatcggccttcacggagtctgcgtagtatgtgaaatcaccagtataaatgactgagacccactccagcccttccctggagcctggcggacccaactcatgtagtttgctgctgacggtgagccagaggctgcacaggagagtctctggaccccccaggctggactaagcctcctccagactccatcagccgcacctcacactggacaccttttaaaagtccaacaaggagaaccagctcagccaaaactccatggtgagtcctctgtgttcagtgctgatcacgaatggaaacacctcggaatcccagtgctgggctcctctcccccaaacccaacgtgcgagtgctaaatcgagcaccggtcgtgtatatactgtctgatggcgcgagggaggcgatacg

SEQ ID NO: 794325 - DNA, 654 bp, Homo sapiens
  misc_feature: 78344.UNK.UNK.UNK.pb.heavy.1.raw 78344
ctatgcgccttgccagcccgctcagacagtatataggaagtagtccttgaccaggcagcccagggccgctgtgcccccagaggtgctcctggagcagggcgccagggggaagacgatgggcccttggtggaagctgaggagacagtgaccagggtgccacggccccatagattgaaagaccagtctcgcctcgcacagaataaacgggccgtgtccgcggcgggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacagaggtccttgactctcagaaagcatcccaaacccaactatatcgagctaaatcgagcacccggtcgtgtatatactgtctgatggcgcgagggaggcgatacg

SEQ ID NO: 794326 - DNA, 669 bp, Homo sapiens
  misc_feature: 78352.44.45.E01.1.pb.heavy.1.raw 78352
cgtatcgcctccctcgcgccatcagacagtatatacacgaccggtgctcgatttagtgagtcagtaagggaaaggggctggagaggagcccagcactagaagtcggcggtgtttccattcggtgatcagcactgaacacagaggactcaccatggagtttggctgagctgggttttcctcgttgctcttttaagaggtgtccagtgtcaggttcagctggtggagtctggggaggcgtggtccagcctgggacgtcctgagactctcctgtgttgcgtcggactcagtttcagtgactctgccatgcactgggtccgccaggctccaggcaaggggctggagtgggtggcagtcatctgtctgatggaagtaaagaatactatggaaactccgtgaagggcgattctcgtctccagagacaattccaagaacaccgtgtatctacaaatgaacaatttgagagccgaggactcggctctctattattgtacgagcccatcgttctactgggccaggagccctggtcaccgtctcctcagcctccaccaagggcccatcggtcttccccctggcgccctgctccaggagcacctcgagagcacagcggcctggctgcctggtcaaggactacttcctatatactgtctgagcggctggcaaggcgcatag

SEQ ID NO: 794327 - DNA, 706 bp, Homo sapiens
  misc_feature: 78360.44.36.D03.1.pb.heavy.1.raw 78360
cgtatcgcctcccctcgcgccatcagacagtatatacacgaccggtgctcgatttagctgcgtcacgatctctcttgggagctctgagagcggagccccagccccagaattcccaggtgttttcatttggtgatcagcactgaaacacagaggactcaccatggagttcgggctgagctgggttttccttgttgttattttacaaggtgtccagagtgaagtgcagttggtggagtccggggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggcagggaaccctggtcaccggtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794328 - DNA, 732 bp, Homo sapiens
  misc_feature: 78367.UNK.UNK.UNK.pb.heavy.1.raw 78367
cgtatcgcttcctcccttacagcgcccatcagacagtaatatcacgacgaccggtgctcgactttagcacactccgcacgttgggttggtggggagaggagcccaagcactggggattccgaggtgtttccattcggtgatcagcactgaacacagaggacctcaccatggagttttggctgagctgggttctccttgttggacttttaaaaggtgtccagtgtgaggtgcggctgatggagtctggaggaggcttagtccagccctgggggtcccagagactctcctgtgcagcctctgggctcaccgtcaggcagcactacatgagttgggtccgccaggctccagggaaggggctggagtgggtctcagtcatttatatactggtgatttcacatactacgcagactccgtgaagggccgattcaccatctccagggacaattccaggaacacggtttatcttcaaatgaacaacctgagaggcgacgacacggccgtctatttactgtgcgagacaagtcggcgctcggagtggtttattattcgtttgacttctggggccagggaaccctggtcaccgtcggcctccccgcctccaccaagggccccatcggtcttccccccctggcacccctcctccaagagcacctctgggggcacagcggccctgggcgcctggtcaaggactacttcctatatactgtctgagcgggctggcaaggcgcatag

SEQ ID NO: 794329 - DNA, 729 bp, Homo sapiens
  misc_feature: 78370.44.86.H09.1.pb.heavy.1.raw 78370
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggcgaccgtggtcccttggccccaggcgtccataccattggagtagagcatgtcatatctgtatccaccgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 794330 - DNA, 700 bp, Homo sapiens
  misc_feature: 78393.44.55.E11.1.pb.heavy.1.raw 78393
cgtatcgcctcctcgcgccatcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggcgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794331 - DNA, 669 bp, Homo sapiens
  misc_feature: 78403.UNK.UNK.UNK.pb.heavy.1.raw 78403
ctatgcgccttgccagcccgctcagacagtatataggaagtagtccttgaccaggcagcccagggccgctgtgctctcggaggtgctcctggagcaggcgccaggggaagaccgatgggcccttggtggaggctgagagacggtgaccagggttccctggcccgaatgaaaccatccagacagtatagacggctgtgtcctcggtgttcaggctgttcatctgcagagacaccgtatctttgaatcatctcttgagatggtgaatctgctttcacggtgcagcgtagtctgctgtcccaccgtcagctttggttctaatacggccaacccactccagccccttccctggagcctggcggacccaggtcatccaggcgttactgaaagtgaatccagaggctgcacaggagagtctaagggactcccaggctttaccaaacctcccccagactccacaactgcacctcacactggacaccttttaaaatagcagcaaggaaaatccagctcagcccaaactccatggtgagtcctctgtgttcagtcctgatcactgaatgaaaacacctgggaatccaaggctggggctcctctcccagagctcaacacactctctctaaatcgagcacgtcgtgatgtatagactgatggcgcgagggaggcgatacg

SEQ ID NO: 794332 - DNA, 724 bp, Homo sapiens
  misc_feature: 78415.44.85.H08.1.pb.heavy.1.raw 78415
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctggggttttcctcgttgctcttttaagaggtgtccagtgtcaggtgcagctggtggagtctggggaggcgtggtccagcctgggaggtccctgagactctcctgtgcagcgtctgggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794333 - DNA, 651 bp, Homo sapiens
  misc_feature: 78434.44.53.E09.1.pb.heavy.1.raw 78434
cgtatcgcctccctcgcgccatcagacagtatatacacgaccggtgctcgatttagagagagtgtgttgggttttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagcccccaggagaggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaatctactacgcttgggacgtcggggccaagggaccacggtcaccgtctcctcatcctcagctccacaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794334 - DNA, 701 bp, Homo sapiens
  misc_feature: 78451.UNK.UNK.UNK.pb.heavy.1.raw 78451
ctatgcgccttgccagcccgctcagacagtatataggagtagtcttgaccaggcaggccagggccgctgtgctctcggaggtgctcctggagcagggcgccaggaggaagaccgatgggcccttggtggaggccgaggagacggtgacagggttccctggccccaggcgtcgaatgaaccgatttgaaacagatagctcccgcacaaaaatacacggccgtgtcctgaggtctcaggctgttcatttgaagagacactgtgttctcggaattgtctctggagatggtgatcggcctccggaatcaccgtagacttgatttcctccatgaaatgacaacctgccacccactccagccctcgcctggagcctggcggacccactgcatattccaattatcgaaggtgaaccagaggcctggcacaggagagtctcagggaacccccccctactggggccacgctccccagactccacgaattgcacctgacacatgacacctcttaagaggcgcacgagaaaaccagctcagcccaaactccatggtgagtcctctgtgttcagtgaatgatcaccgagtggaaacaccggcgacttccagtgctgggcccgtctcccaggccaaaaacccttccgatcgcgtctaaatccggagcaccggtcgtgtatatatactgtctgatggcgccgaggaggcgatacg

SEQ ID NO: 794335 - DNA, 707 bp, Homo sapiens
  misc_feature: 78453.UNK.UNK.UNK.pb.heavy.1.raw 78453
cgtatcgcctccctcgcgccatcagacagtatatacacgaccgtggctcgatttagctgcgtcacgatctctctgggagctctcagagagtgccttagccctggattccaagcaatttccacttggtgatcagcaatgacacagaaggaccaccatggagttggggctgcgctgggtttttccttgtttgctattttagaaggtgtccactgtgaggtgcggctggtggagtctggggaggcttgggtacacgggggggtccctgagactctcctgtgcagcctctggattcatcttcagtgactatgccatgaactggggtccgccaggctccagggaaggggctggagtgggttttcatatgttaaatattgctgagataccacctactacgccagactctgtgaaggccgattcccccaattccagggacaattgccaagactcactgtatctggaaatgaacagcctgagagaccgaggacacggctgtcacttctgttcgatgagatcgggccacttggtcagtgctggtttgacctactggggccgggaaccctggtcccgtctcctcaggcctccaccaaggcccatcggtcttccccctggcgccctgctcagagcaccctccgagagcacagcgcccctggctgcctggtcaaggactacttcctatatactgtctgagcgggcggcaaggcgcatag

SEQ ID NO: 794336 - DNA, 700 bp, Homo sapiens
  misc_feature: 78454.44.55.E11.1.pb.heavy.1.raw 78454
ctatgcgccttgccagccgctcagacagtatataggaagtagtccttgaccaggcagcccagggccgctgtgcccccagaggtgctcttggaggagggtgccagggggaagaccgatgggccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatgggtgaatcggcccttcacggagtctgcgtagtatgtgaaatcacagtataaatgactgagacccactccagccccttccctggagcctggcggacccaactcatgtagttgctgctgacggtgagcccagaggctgcacaggagagtctctgggacccccaggctggactaagcctcctccagactccatcagccgccctcacactggacaccttttaaaagtccaacaaggagaacccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgtatatactgtctgatggcgcgaggaggcgatacg

SEQ ID NO: 794337 - DNA, 685 bp, Homo sapiens
  misc_feature: 78455.44.27.C05.1.pb.heavy.1.raw 78455
cgtaatcgcctccctcgcggtatatacacgaccggtgctcgatttagacgcgatcgaagggtttgggagccctggagacgagcccagcactggaagtcgccggtgtttccactcggtgatcatcactgaacacagaggactcacatggagtttgggctgagctgggttttcctcgttgccctcttaagaggtgtcatgtgtcaggtgcaattcgtggagtctgggaggcgtggcccagtagggggtccctgagactctcctgtgcagcctctggattcaccttcgataattggaatatgcagtgggtccgccaggctccaggcgagggctggagtggtggcagtgtgtcatttcatggaggaaatcaagtctacggtgattccgttgagggccgattcaccatctccagagacaattccgagaacacagtgtctcttcaaaatgaacagcctgagacctcaggacacggccgtgtattttgtgcgagactatctgttccaaatcggttcattcgacgcctggggccaggaacccctggtcaccgtctcctcgcctccaccagggccatcggtcttcccctggcgccctgctccaggagcacctccgagagcacagcggccctgggctgcctggtcaaggactacttcctatatactgtgtctgagcgggctggcaaggcgcatag

SEQ ID NO: 794338 - DNA, 652 bp, Homo sapiens
  misc_feature: 78465.44.86.H09.1.pb.heavy.1.raw 78465
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcctcaagagtcgtctcaccatttcgagggacacgtccatgaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794339 - DNA, 550 bp, Homo sapiens
  misc_feature: 78475.44.43.D10.1.pb.heavy.1.raw 78475
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccagggttccctggccccaggggtcgaaccacctccccgacgagctgctatactttcgggatctcgcacagtaatacacggccgtgtcctcagatctcaggctgctcagctccatgtaggctgtgtttatggaggtgttcctggtcatggtgactctgccctggaacttctgtgcatagcctgtgttaccactgttagggttcatccatcccatccactcaagcccttgtccagtggcctgtcgcacccagttgatatcataattggtgaaggtgtatccagaagccttgcaggagaccttcactgaggccccaggcttcttcacctcagccccttactgctagtctaaatcgagcaccggtcgtgtatatactgtctgatggcgcgagggaggcgatacg

SEQ ID NO: 794340 - DNA, 695 bp, Homo sapiens
  misc_feature: 78490.44.27.C05.1.pb.heavy.1.raw 78490
ctatgcgccttgccagcccgctcagacagtatataggaagtagtccttgaccaggcagccagggccgctgtgctctcggaggtgctcctggagcagggcgccagggggaagacgatgggcccttggtggaggccgaggagacggtgaccagggttccctggcccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgcacccactccagcccctcgcctggagcctggcggacccactgcatattccaattatcgaaggtgaatccagaggctgcacaggagagtctcagggaccccctactggggcacgcctcccaagactccacgaattgcacctgacacatgacacctcttaagagggcaacgaggaaaaccagctcagccaaactccatggtgagtcctctgtgttcagtgatgatcaccgagtggaaacaccggcgacttccagtgctgggctcgtctcccggccccaaacccttcgatcgcgtctaaatcgagcaccggtcgtgtatatactgtctgatggcgcgagggaggcgatacg

SEQ ID NO: 794341 - DNA, 715 bp, Homo sapiens
  misc_feature: 78510.UNK.UNK.UNK.pb.heavy.1.raw 78510
ctatgcgcctgccagcccgctcagacagtaataggaagtagtccttgaccaggcagcccagggccgcctgtgcccccagaggtgctcttggaggagggtgccaggggaagaccgatgggccttgtggagcggaggcgacggtgaccagggttccccggcccagaagtcaaacgaataataaccactccgagcgccgacttgtcctcgcacagtaatagacggccgtgtcgtcgcctctcaggtttgtttcacttgtaagataaccgtgtttcctggaattgtccctggagatggtgaatcggccccttcaggcggtctgcctagtatgtgaaatcaccagtaaaatgactgagacccactcagcccttccctgagcctggcggacccaactcatgtagttgctgctggacggtgagcccagaggctgcacagggagagtctctgggaccccccaggctggactaagcccctccagactccatcagccgcacctcacactggacaccttttaaagtccaacaagggagaacccagctcagccaaaactcatggtgagtcctcgtgtgtcagtgctgatcacccgaatggaaacacctctcggaatccccagtgctgggctccttctcccaagcccccccaaaccccaacgtgcgagtgctaaatcgagcaccggtcgggtgtatatactgtctgatgcggcgcagggaggcgatac

SEQ ID NO: 794342 - DNA, 683 bp, Homo sapiens
  misc_feature: 78531.44.9.A09.1.pb.heavy.1.raw 78531
cgtatcgcctccctcgcgccatcagacagtatatacacgaccggtgctcgatttagcgagacgcgcagggggggagacgagcccagcactggaagtcgccggtgtttccattcggtgatcatcactgaacacagaggactcaccatggactttgggctgagatgggttttcctcgttgctctttaagaggtggccagtgtcaggtgcagctagtggagtctggggaggagcggccagcctgggaactccctgagactctcctgtgcagcctctggattcatctcaggacctatgccatgcactggtccgccaggctccaggcaagggctggagtgggtggcaattatatcagaagatggaattgaagaacactacggagactcgagaagggccgattcaccgtctccagagacaattccaggaacacactgcatctgcaaatgtacaacctcacaagtgaggacacggctgtctattattgtgcgagagccccctcgagacggtcccgcttgactactggggccagggaaccctggtcaccgtctcctcagcctccaccaagggcccatcgtcttcccctggcgccctgctccaggagcacctccgagagcacagcggccctgggctgcctggtcaaggactacttcctatatactgtctgagcgggctggcaaggcgcatag

SEQ ID NO: 794343 - DNA, 691 bp, Homo sapiens
  misc_feature: 78544.44.45.E01.1.pb.heavy.1.raw 78544
cgtatcgcctcccctcgcgccatcagacagtatataccacgaccggtgctcgatttagtgagtcagtaaggggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaagggggctggagtggggtggccagtcatctggtctgatggaagtaaagaatactaatggaaactccgtgaaagggccgattctccgtctccagagacaattccaagaacaccgtgtatctacaaatgaacaatttgagagccgaggactcggctctctattattgtacgaagcccatcgttctactggggccagggagccctggtcaccgtctcctcagcctccaccaagggccatcggtcttccccctggcgccctgctccaggagcacctccgagagcacagcgccctggggctgcctggtcaaggactacttcctatatactgtctgagcgggctggcaaggcgcatag

SEQ ID NO: 794344 - DNA, 712 bp, Homo sapiens
  misc_feature: 78548.44.62.F07.1.pb.heavy.1.raw 78548
cgtatcgcctccctcgcgccatcagacagtatatacacgaccggtgctcgatttagtagtcgcataaagggaaaaggggagctctgagagaggagcccagccctgggattttcaggtgtcttcatttggtgaccaggaccgaacagagagaagtctccatggagtttgggctgagctgccttttcttgtggcttttttaagggtgtcgtgtgtgaagtgcagttgttggagtctggggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttgggccgggggacagtggtgaccgtctctttcaagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794345 - DNA, 703 bp, Homo sapiens
  misc_feature: 78553.44.55.E11.1.pb.heavy.1.raw 78553
cgtatcgcctccctcgcgccatcagacagtatatacacgaccggtgctcgattagcactcgcacgttgggtttggggaagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggagggcttagtccagcctggggggtcccagagactctcctgtgcagcctctgggctcaccgtcagcagcaactacatgagttgggtccgccaggctccagggaaggggctgagtgggtcctcagtcattttatactgtgatttcacatactacgcagactccggtgaagggccgattcaccatctccaggacaatttccaggaacacggtttatcttcaatgaacaacctgagaggcgacgacacggccgtctattactggtgcgagacaagtcggcgctcggagtggttattatcgtttgacttctggggccagggaaccctggtcacccgtcgcctccgcctccaccaagggcccatcggtcttccccctggcaccctcctccaagagcactctgggggcacagcggccctgggctgcctggtcaaggactacttcctatatactgtctgagcgggctggcaaggcgcatag

SEQ ID NO: 794346 - DNA, 734 bp, Homo sapiens
  misc_feature: 78581.UNK.UNK.UNK.pb.heavy.1.raw 78581
cgtaatcgcctcccctccgcgccatcagacagtatcatacacgaccggtgcttcgatttagtatcactcagtcgcgggggggctctggagaggagccagcactagaagtcggcggtgtttccattcggtgatcagcactgaacacagaaggactcaccatggagttttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctcgcaggcaaggggctggagtgggtggcacttaatatggtatgatggaagtaataaatactatgcagactccgtgaagggccgattcaccatctccagagacaattccaagaacacgctgtatctgcaaatgaacagcctgagagcccgaggacacggctgtgtattactgtgcgaggacatattgtagtacaccacctgctgggactactactacggtatggacgtctggggcaaaagaggaccacggtcaccgtctcctcagcctccaccaagggcccatccggtcttccccctggcaccctcctccagagcacctctgggggcacagcggccctgggcctgcctggtcaagggactactcctatatactgtctgagcgggctggcaaggcgcatag

SEQ ID NO: 794347 - DNA, 662 bp, Homo sapiens
  misc_feature: 78603.44.86.H09.1.pb.heavy.1.raw 78603
ctatgcgccttgccagcccgcctcagacagtatataggaagtagtccttgaccaggcagcccagggccgctgtgcccccagaggtgctcctggagccagggcgccaggggaaggaccgatgggcccttggtggaagctgaggagacagtgaccagggtgccaccggcccccatagattgaaagaccagtctcggcctcgcacagaaaataaacgggccgtgtccgggcggcggtcacggaggtcagttcaggagaagcgtcatggacgtgtcctcgaaatggtgagacgactcttgaagggacggggagagtagtacgtcggcccagtataatggatgtcaccaatccactccattccctccctgggggcgccggatccagccccaagaatgatcagaactgatggaaactccagagacagtgcagatgagcgagacagggttcccgaaggcctcaccagtcctgccccgactcctgcagctgcacctgggacaggaccccatctgggagctgccaccagcaggaggaaaaaccacagtgcttcatgttcttgcacaggaggtccttgactctcagaaagcatccccaaacccaagtctatagcactaaatcgagcaccggtcgtgtatatactgtccgatgggcgcgagggaggcgatacg

SEQ ID NO: 794348 - DNA, 687 bp, Homo sapiens
  misc_feature: 78615.44.6.A06.1.pb.heavy.1.raw 78615
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggctttgagtggattgggtggaatcatccctctttttggctcactcacctacgcacgagactttccggggcagaattacgaattacccgcggacaagtccaacagacacagtctccatgacaatgagttcttttgaaatccgacgacacggccgtctactactgtgcgagaggtccgtaaccccagctcgcatggagccttttgagattctgggggcagggaaaccctggtcattgtcacctcagcttccaccaagggcccatcggtcttccccctggcgccctgctccaggagcacctctgggggcacagcggccctgggctgcctggtcaaggactacttcctatatacttgtctgagcgggctggcaaggcgcatag

SEQ ID NO: 794349 - DNA, 628 bp, Homo sapiens
  misc_feature: 78636.UNK.UNK.UNK.pb.heavy.1.raw 78636
gaaggctggggcaggctatgcacccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactcttgcggttaggggaagtagacaaaaccccattactccacttcccggaagttcaactcattccaaccacgaaataaagtaaactcaacaccccaaagcaggctatgtgggggggggtgataggggtggattctatttttcctatcccatcccctaggatctcaattaagttactagcgagttaaatgtctgtagccgattcccgtcagtccttatcgcgcgcatcaagacctggttggttgagcgtgccagtagatcatcgataagctgccgagttaggtcatcccagaccgcatctggcgcctaaacgttcagtggtagctaaggcgtcaccttcgactgtctaaaggcaatatgtcgttccttagctccagagtcgtccctagcaggcgtgtcggg

SEQ ID NO: 794350 - DNA, 691 bp, Homo sapiens
  misc_feature: 78637.UNK.UNK.UNK.pb.heavy.1.raw 78637
ctatgcgccttgccagcccgctcagaccagtatataggaagtagttccttgaccaggcaggcccaggggccggccggggtgccccagaggtgctcttggaggaggggtgccagggggaagacgatgggccccttgtggaggctgaggagaccgggtgaccagggttccctggccccaggggtcgagccagttcgccccccccgtctctacgtgtatcgataggaatcctctcgcacaataatatacggccgtgtccgcggcggtcacagaagtcaatttcagggagaactggttcttggaccgtgtctagtgacatggtgactcgactcttgaggcgggttgtagttggtgctgccactgttatagatgcggcccaatccactccagtcccttccgcggactgccgcagccaacttccaataataactactgatgtaaccaccagagacattgcaggtggaggacagggtctccgaaggcttcacccgtcctgggccgccgactcctgcagctgcacctcggacacgaccccatctgggaggtgccacgggaggagaagaaccacaggtgtttcatgttcttgtgcagggggcccatgagtctcagaaagtatccccaaacccaactatcgtgtggctaaatcgagcacggtcgtgtatatactgtctgatggcgcggaggaggcgatacg

SEQ ID NO: 794351 - DNA, 572 bp, Homo sapiens
  misc_feature: 78640.44.53.E09.1.pb.heavy.1.raw 78640
cgtatcgcctccctcgcgccatcagacagtatatacacgaccggtgctcgatttagagagagtgtgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794352 - DNA, 705 bp, Homo sapiens
  misc_feature: 78664.44.36.D03.1.pb.heavy.1.raw 78664
ctatgcggccttgccagcccgctcagacagtatataggagtaggtccttgaccaggcagccagggcggctgtgctctcggaggtgctcctggagcaggggcgccaggggaagaccgatgggccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaaatctggctttcacagacgcggccgtactctgtgataagctggcaacttttgtttttactgcggccaagccactccagccccttccctggagcctggcggacccagtccatatagtggtcactgatggtgaatccagaggcgacacaggagagtctcagggaccctccaggctggaccaagttctccccggactccaccaactgcacttcactctggacaccttgtaaaataacaacaggaaaaaccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 794353 - DNA, 681 bp, Homo sapiens
  misc_feature: 78665.UNK.UNK.UNK.pb.heavy.1.raw 78665
cgcgtatcgcctccctccccgcgccatcagacagtatataccgcacgacggtgctcgatttagtagtgtagattccgcggcgggctttcctgagagtcatggacctcgcgtgtgcacagaacatgagcagctgtggttgctcttctcctggctgcctcctgcgcgggcggctcgcagatgggtcctgtcccagctgcagctgcaggagtcgggcccaggactggtgaagccttcggagacccctgtccctcacctgcactgtctctggtggctccatcagcagtagtagttactactggggctggatccgccagcccccaggaaaggggcggagtggatcggagtatctattatagtgggagcacctactacaacccgtccctcaagagtcgagtcaccatatcagtagacacgtccaagaaccagttctctccctgagctgagctctgtgaccgccgcggacacgccggtgtattactgtgcgagagtagggcagttcgtcaccaactactttgaccactggggccagggaaccctggtcaccgtctcctcagcctccacaagggccatcgggtcttcccctggcaccctcctccaagagcacctctgggggcacagcggcctggctgcctggtcaaggactacttcctatatactgtctgagcggctggcaaggcgcat

SEQ ID NO: 794354 - DNA, 620 bp, Homo sapiens
  misc_feature: 78681.44.38.D05.1.pb.heavy.1.raw 78681
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccttttaaaatagcaacaaggaaaaacccagctatcagatactaaatcgagcaccggtcgtgtatatactgtctgatggcgcgcgaggaggcgatacg

SEQ ID NO: 794355 - DNA, 721 bp, Homo sapiens
  misc_feature: 78682.UNK.UNK.UNK.pb.heavy.1.raw 78682
ctatgcgccttgccagccgctcagacagtatataggaagtagtccttgaccaggcagccagggccgctgtgccccagaggtgctcttggaggagggtgccaggggaagaccgatgggcccttggtggaggctgaggagacggcgaccgtggtcccttggccccaggcgtccataccattggagtagagcatgtcatatctgtatccacgaggcccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggaccagtgcatgcatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctccagagctccccaacccaagtctatagcactaaatcgagcacggtcgtgtatatactgtctgatggcgcgagggaggcgatacg

SEQ ID NO: 794356 - DNA, 683 bp, Homo sapiens
  misc_feature: 78694.44.53.E09.1.pb.heavy.1.raw 78694
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttggggctgagctggattttccttgctgctattttaaaaggtgtccagtgtgaggtggcagttggtggagtctggggaggtttgtaaagcctggggagtcccttagactctcctgtgcagcctctggattcactttcagtaacgcctggatgacctgggtccgccaggctccagggaaggggctggagtgggtttggccgtattagaaccaaagctgacggtgggacagcagactacgctgcacccgtgaaaggcagatcaccatctcaagagatgattcaaaagatacggtgtctctgcagatgaacagcctgaacaccgaggacacagcccgtctattactgtctgggatggtttcattcgggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794357 - DNA, 581 bp, Homo sapiens
  misc_feature: 78699.UNK.UNK.UNK.pb.heavy.1.raw 78699
cgtatcgcctccctcgcgccatcagacagtatatacacgaccggtgctcgatttagtgtgagtgtttgggtttggggaagaggaagactgacggtcccactcccaggtacagctggtgcagtctggggctgaggtgaagaagcctgggcctcagtgacagtctcctgcacggcttctggtacacgttcatcaattatgatattaactgggtgcgacaggccgctggacaagggctggagtggatgggatggatgaagcctatagtggcaacacgggctttgcccagaagttccaaggcagagtttagtatgaccaggagcacctcccaggtacagtctacatggaactgagcagcctgagatctgaggacacggccgtgtatttctgtgcgagagccaccagcacctgcttgacttgtggggccagggaccctggtcaccgtctcctcagcctccaccaaggcccatcggtcttcccctggcgccctgctccaggagcacctccgagagcacagcggccctgggctgcctggtcaaggactacttcctatatactgtctgagcggctggcaaggcgcatag

SEQ ID NO: 794358 - DNA, 705 bp, Homo sapiens
  misc_feature: 78717.44.27.C05.1.pb.heavy.1.raw 78717
ctatgcgccttgccagcccgctcagacagtatataggaagtagtccttgaccaggcagcccagggccgctgtgctctcggaggtgctcctggagcagggcgccagggggaagaccgatgggccctggtggaggccgaggagacggtgaccagggttccctggccccaggcgtcgaatgaaccgattttggaaacagatagtctcgcacaaaaatacacggccgtgtcctgaggtctcaggctgtttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattcccaattatcgaaggtgaatccagaggctgccaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatattactgtctgatggcgcgagggaggcgatacg

SEQ ID NO: 794359 - DNA, 704 bp, Homo sapiens
  misc_feature: 78722.44.55.E11.1.pb.heavy.1.raw 78722
cgtatcgcctcctcgcgccatcagacagtatatacacgaccggtgctcgatttagcactcgcacgttgggtttggggggagaggagcccagcactgggattccgaggtgtttccattcggtgatcagcactgaacacagaggactcaccatgagttttggctgagctgggttctccttgttggacttttaaaaggtgtccagtggtgaggtgcggctgatggagtctggaggaggcttagtccagcctgggggtcccagagactctctgtgcagcctctgggctcaccgtcagcagcaactacatgagttgggtccgccagggctccaggaaggggctggagtgggtctcagtcatttatactggtgatttcacatactacgcagactccgtgaagggccgattcaccatctccaggacaattccagggaaacacggtttatcttcaaatgaacaacctgagaggcgacgacacggccgtcctattactgtgcgagacaagtcggcgctcggagtggttattattcgtttgacttctggggccaggggaaccctggtcaccgtcgcctccgcctccaccaagggcccatcggtcttccccctggcaccctcctccaagagcacctctgggggcacagcgccctgggctgcctggtcaaggactactcctatatactgtctgagcgcggctggcaaggcgcatag

SEQ ID NO: 794360 - DNA, 672 bp, Homo sapiens
  misc_feature: 78730.44.45.E01.1.pb.heavy.1.raw 78730
cgtatcgcctccctcgcgccatcagacagtatatacacgaccggtgctcgatttagtgagtcagtaagggaaaggggctgggagaggagccagcactagaagtcggcggtgtttccattcggtgatcagcactgaacacagaggactcaccatggagtttgggctgagctggttttcctcgttgctcttttaagaggtgtccagtgtcaggttcagctggtggagtctggggaggcgtggtcagcctgggacgtccctgagactctcctgtgttgcgtccgactcagtttcagtgactctgccatgcactgggtccgccaggctccaggcaaggggctggagtgggtggcagtcatctggtctgatggaagtaaagatactatggaaactcgtgaagggccgattctccgtctccagagacaattccaagaacaccgtgtatctacaaatgaacaatttgagagccgaggactcggctctctattattgtacgagcccatcgttctactgggccagggagcctggtcaccgtctcctcagcctccaccaagggcccatcggtcttcccctggcgccctgctccaggagcacctccgagagcacagcggccctgggctgctggtcaagaactacttcctatatactgtctgagcgggctggcaaggcgcatag

SEQ ID NO: 794361 - DNA, 703 bp, Homo sapiens
  misc_feature: 78731.44.36.D03.1.pb.heavy.1.raw 78731
ctatgcgccttgccagcccgctcagaccagtatataggaagtagtccttgaaccaggcagcccagggccgctgtgctctcggaggtgctcctggagcagggcgccagggggaagaccgatgggcccttggtggaggctgaggagacggtgaccaggggttccctggccccaatggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagcccttccctggagcctggcggacccccagctcccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctccccaagagagatcgtgacgcagctaaatcgagcaccggtcgtgtatatactgtctgatggcgcgagggaggcgatacg

SEQ ID NO: 794362 - DNA, 691 bp, Homo sapiens
  misc_feature: 78732.44.21.B10.1.pb.heavy.1.raw 78732
cgtatcgcctccctcgcgccatcagacagtatatacacgaccggtgctcgatttagtgtcgtcgcaagagagagcggagccccagccccagaattcccaggtgttttcatttggtgatcagcactgaacacagaggactcaccatggagttcgggctgagctgggttttccttgttgttattttacaaggtgtccagagtggaagtgcagttggtggagtccgggggagacttggtccagcctggagggtccctgagactctcctgtgtcgcctctggattcaccaatcagtgaccactatatggactggggtccgccaggctccagggaaggggctggagtggcttggccgcagtaaaacaaagtgccagctttatcacagagtaccgccgcgtctgtgaaagccagattcaccctctcaagagatgactttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggttcttcccctggcgccctgctccaggagcacctccgagagcacagcggccctggctgcctggtcaaggactacttcctatatactgtctgagcgggctggcaaggcgcatag

SEQ ID NO: 794363 - DNA, 686 bp, Homo sapiens
  misc_feature: 78739.44.45.E01.1.pb.heavy.1.raw 78739
ctatgcgccttgccagcccgcttcagacagtataaggaagtagtccttgaccaggcagccagggcgctgtgctctcggaggtgctcctggagcagggcgccaggggaagaccgatgggcccttggtggaggctgaggagacggtgaccagggctccctggccccagtagaacgatgggctcgtacaataatagagaggccgagtcctcgctctcaaattgttcatttgtagatacacggtgttcttggaattgtctctggagacggagaatcgggcccttcacggagtttccatagtattctttacttccatcagaccagatgacttgcccacccactccagccccttgctggagcctggcggacccagtgcatggcagagtcactgaaactgagtccggacgcaacacaggagagtctcagggacgtccccaggctggaccacgcctccccccagactccaccagctgaacctgacactggacacctcttaaaagaggcaacgaggaaaacccagctcagcccaaactccatggtgagtcctctgtgttcagtgctgatcacccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794364 - DNA, 689 bp, Homo sapiens
  misc_feature: 78740.UNK.UNK.UNK.pb.heavy.1.raw 78740
cgtatcgccatccctcccgcgccatcagacagtatatacacgacggtgctcgatttagagtatacatattgggtttgggggggagaggagcccagcaactgggattccgaggtgtttcattcggtgatcagcactgaacacagaggacctcaccatgagttttggctgagctgggttctccttgttggactttgtccagtgtgaggtgcggctgatggagtcggagaggcttcagtccagccgtgggggtcccagagactctcctgtgcagcctctgggctcccgtcagcagcaactacatcggtgggtccgccaggcctccagcaggcctggagtgggatctcaagtcatttatactggtgatttcacatactacgcagactcccgaaccgattcccatctccagggacattccaggaacacggtttatcttctcaaatgaacaacctgagaggcgacgaccgacggcgtctattactgtgcgagacaagtcggcgctcggagtggttattattcgtttgacttctggggccagggaaccctgtcaccgtcgcctccgcctccacaaggcccatcggtcttcccctggcaccctcctccaagagcacctctggggcacagcggccctgggctgcctggtcaagactacttcctatatactgtctgagcgcggctggcaaggcgcatag

SEQ ID NO: 794365 - DNA, 537 bp, Homo sapiens
  misc_feature: 78744.44.38.D05.1.pb.heavy.1.raw 78744
cgtatcgcctccctcgcgccatcagacagtatatacacgaccggtgctcgatttagtatctgatagttgggtttggggggtccctgagactctcctgtgcagcctctggattcaccttcagtagctactggatgcactggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctgggccaagggaccacggtcaccgtctcctcagcttccaccaagggcccatcggtcttcccctgcgccctgctccaggagcacctctggggcacagcggccctggctgcctggtcaaggactacttcctatatactgtctgagcgggctggcaggcgcatg

SEQ ID NO: 794366 - DNA, 682 bp, Homo sapiens
  misc_feature: 78747.UNK.UNK.UNK.pb.heavy.1.raw 78747
cgtatcgcctcctcgcgccatcagacagtatatacacgaccgtgctcgatttagacgcgatcgaaggtttgggctgggagacgagcccagcacggaagtcgccggtgttccactcggtgatcatcactgaacacagaggactcaccatggagttggctgagctgggtttcctcgttgccctcttaagaggtgtcaatgtgtcaggtgcattcgtggagtctggggaggcgtggcccagtaggggggtccctgagactctcctgtgcagcctctggattcaccttcgataattggaatatgcagtgggtccgccaggctcaggcgagggctggagtgggtggcaggtgtgtcattcatgaggaatcagtcttacggtgattccgttgagggccgattcaccatctccagagacaattccgagaaacagcagtgtctcttcaaatgaacagcctgagactcaggacacggcgtgtatttttgtgcgagactatctgtttccaaatcggttcattcgacgcctgggcccaggaacctggtcaccgtctcctcggcctccaccaagggcccatcgttctcccctggcgccctgctccaggagcacctccgagagcacagcggccctgggctgcctggtcaaggactacttcctatatactgtctgagcggctggcaaggcgcatag

SEQ ID NO: 794367 - DNA, 698 bp, Homo sapiens
  misc_feature: 78769.44.36.D03.1.pb.heavy.1.raw 78769
ctatgcgccttgccagcccgctcagacagtatatagaagtagtccttgaccaggcagcccagggccgctgtgctctcggaggtgctcctggagcagggcgccaggggaagaaccgatgggcccttggtggaggctgaggagacggtgaccagggttccctggccccagtggacagttcctgatataaacacaacacaataatacatgccgtgtcctcggttttcaggttagtcattcgcagatcaatgagttcttgaagtcatctcttgagagggtgaatctggctttcacagacgcggcgtactctgtgataaagctggcaactttgtttttactgcggccagccactccagccccttccctggagcctggcggacccagtccatatagtggtcactgatggtgaatccagaggcgacacaggagagtctcagggaccctccaggctggaccagtctccccccggactccaccaactgcacttcactctggacccttgtaaaataacaacaaggaaaacccagctcagcccgaactccatggtgagtcctctgtgttcagtgctgatcaccaaatgaaacacctgggaattctggggctggggctccgctctcagggctccccaagagagatcgtgacgcagctaaatcgagcaccggtcgtgtaatactgtctgatggcgcgagggaggcgatacg

SEQ ID NO: 794368 - DNA, 705 bp, Homo sapiens
  misc_feature: 78797.44.36.D03.1.pb.heavy.1.raw 78797
cgtatcgcctccctcgcgccatcagacagtagatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtggaccactatatggactgggtccgccaggctccaggaaggggctggagtggcttggccgcagtaaaacaaagttgccagctttatcacagagtacgccgcgtcgtgaaagccagattcaccctctcaagagatgactttcaagaactcattgattctgcgaatgactaacctgaaaaccgaggacacgggcatgtattattgtgttgtgtttatatcaggaactgtccactggggccagggaaccctggtcaccgtcttcctcagcctccaccaagggcccatcggtcttccccctggcgcccctgctccaggagcacctccgagagcacagcggcctgggctgcctggtcaaggactacttcctatatactgtctgagcgggctggcaaggcgcatag

SEQ ID NO: 794369 - DNA, 691 bp, Homo sapiens
  misc_feature: 78817.UNK.UNK.UNK.pb.heavy.1.raw 78817
cgtatcgcctcctccctcgcgccattcagacagtatatacacgaccggtggctcggatttagctcgatatagttgggtttggatgctttctgagagtcaaggacctcctgtgcaagaacatgaagcacctgtggttttttcctcctgctggtggcaagctcccagatggggtcctgtcccaggtgcagctgcaggagtcggggcccaggactggtgagggccttcgggaaacctgtctctcatctgcactgtctctggagtttccatcagttctgatcattccttggggctgggatccggcaagcccccagggaggggaatggagtggattggtggacatccatttatactgggggccgacgtactactctccgtccctcaagaggtcgtcctcaccatttcgagggacacgtccatgaaccgcttctccctgaaaactgacctccgtgaccgccgcggaacacggccgtttattttctgtgccgaggcgagactggtcctttcaatctatggggccgtggcaccctggtccactgtcttcctcagcttccaccaagggcccatcggtcttccccccctggcgccctgctcccaggagcaccttctggggggcacagcggcctgggctgccctggtccaaggactacttccctaatatactgtctggcgggggcctggccaaggcgcatag

SEQ ID NO: 794370 - DNA, 706 bp, Homo sapiens
  misc_feature: 78819.44.36.D03.1.pb.heavy.1.raw 78819
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggggagacttggtccagcctggagggtcctgagactctcctgtgtcgcctctggattcaccatcagtgaccactatatggactgggtccgccaggctccagggaaggggctggagtggcttggccgcagtaaaacaaagttgccagctttatcacagagtacgccgcgtctgtggaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatattactgtctgagcgggctggcaaggcgcatag

SEQ ID NO: 794371 - DNA, 703 bp, Homo sapiens
  misc_feature: 78840.UNK.UNK.UNK.pb.heavy.1.raw 78840
cgtatcgcctcctcgcgccatcagaccagtatatacacgaccggtgctcgatttagctggcgtcacgatctctcttggggagctctgagagcgagccccagccccagaattcccaggtgttttcattttggtgatcagcactgacacagaggactcaccatggagttcggggctgagctgggttttccttgttgttattttacaaggtgtccagagtgaagtgcagttgtggagtccgggggagacttggtccagcctggagggtccctgagactctcctgtgtcgcctctgggattcaccatcagtgaccactatatggactggtccgccaggctccagggaaggggctggagtggcttggccgcaagtaaaaacaaagttgccagctttatcacagaagtacgccgcgtctgtgaaagccagattcaccctctcaagagatgacttcaagaactcattgattctgcgaatgactacctgaaaaccgaggacacggcatgtattattgtgttgtgtttatatcaggaactgtccactggggccagggaaccctggtcaccgtctcctccagcctccaccaagggcccatcgtcttccccctggcgccctgctcaggagcacctccgagagcacagcggccctggctgcctggtcaaggactacttcctatatactgtctgagcgggctggcaaggcgcatag

SEQ ID NO: 794372 - DNA, 698 bp, Homo sapiens
  misc_feature: 78853.UNK.UNK.UNK.pb.heavy.1.raw 78853
ctatgcgccttgccagcccgctcagacagtatataggaagtagtccttgaccaggcagcccagggccgctgtgccccagaggtgctcctggagcagggcgtcagggggaagaccgatgggcccttgtggaagctgaggtgacaatgaccaggggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaaagagggatgattccacccatccactcaagcccttgtccaggggcctggcgcaccagtgatggtataaagtagtggaactggtagtacttccagaggccgtgcaggaaagggtcaccgaggaccaaggttgcggccattctagtcccagactgcaccagcttgaccagggactggacacctgttgctggctgccacccacaaagaggaaacctccaggtccagtccatggtgatgagctgtgctcccaggggcttctttagaggaggaatgtggttgttatgtgatgctcccccctgatagagctactaaatcgagcacggtcgtgtatatacgctgtctgatggcgcgagggaggcgatacg

SEQ ID NO: 794373 - DNA, 703 bp, Homo sapiens
  misc_feature: 78855.UNK.UNK.UNK.pb.heavy.1.raw 78855
ctatgcgccttgccagccgctcagacagtatataggaagtagtccttgaccaggcagcccagggccggctgtgctctcggaggtgctcctggagcagggcgccaggggaagaaccgatgggcccttggtggaggctgagagagacggtgaccagggttccctggccccagtggacagttcctgatataaacacaacacaataatacatgcccgtgtcctcgtttcagttagtcattcgcaagaatcaatgagttcttgaagttccatctcttgagagggtgaatctggctttccacagacgcgcgtactctgtgataaagctggcaactttgttttttactgcggccaagccactccagccccttcctgagcctggcggacccagtccatatagtggtcactgatggtgaatccagaggcgacacaggagagtctcagggaccctccaggcctggacaagtctccccggactccaccaactgcacttcactctggacaccttgtaaaataacaacaaggaaaacccagctcagcccgaactccatggtgagtcctctgtgttcagtgctgatcaccaatgaaaacacctggaattctgggctggggctcgcgctctcagagctccccaagagagatcgtgacgcagctaaatcgaagcaccggtcgtggtatatactgtctgatggcgcgaggaggcgatacg

SEQ ID NO: 794374 - DNA, 702 bp, Homo sapiens
  misc_feature: 78861.UNK.UNK.UNK.pb.heavy.1.raw 78861
ctatgcgccttgccagcccgctcagacagtatataggaagtagtccttgaccaggcagcccagggccgctgtgcccccagaggtgctcttggaggagggtgccagggggaagacgatgggcccttggtggaggcggaggcgacggtgaccagggttccctggcccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgcttgacggtgagcccagaggctgcacaggagagtctctggacccccaggctggactaagcctcctccagactccatcagccgcacctcacactggacaccttttaaaagtccaacaaggagaacccagctcagccaaactccatggtgagtcctctgtgttcagtgctgatcaccgaatggaaacacctcggaatcccagtgctgggctcctctcccccccaacccaatatgtatactctaaatcgagcaccggtccgtgtatatactgtctgatggcgcgagggaggcgatacg

SEQ ID NO: 794375 - DNA, 678 bp, Homo sapiens
  misc_feature: 78862.44.73.G07.1.pb.heavy.1.raw 78862
cgtatcgcctccctcgcgccatcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctggggaggcgtggtccagcctgggaggtccctgagactctcctgtgaagcctctggattagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaatgatcagcctgagaggcgaggactcggctctgtattactgtgcgagatcgggaagtggcagcaagctattatcgggcgttcactgggccagggacactggtcaccgtctcctcagcctccaccaaggcccatcggtcttcccctggcgccctgctccaggagcacctccgagagcacagcggccctgggctgcctggtcaaggactacttcctatatactgtctgagcgggctggcaaggcgcatag

SEQ ID NO: 794376 - DNA, 706 bp, Homo sapiens
  misc_feature: 78909.44.55.E11.1.pb.heavy.1.raw 78909
cgtatcgcctccctcgcgccatcagacagtatatacacgaccggtgctcgatttagcactcgcacgttgggtttggggagaggagcccagcactgggattccgaggtgtttccattcgtgatcagcactgaacacagaggactacatctcaccaatggagtttggctgagctgggttctccttgttggacttttaaaggtgtccagtgtgaggtgcggctgatggagtcctggaggaggcttagtcccagcctggggggtcccagagactctcctgtgcagcctctgggctcaccgtcagcagcaactacatgagtttgggtccgccaggctccagggaaggggctggagtgggtctcagtcatttatactggtgatttcacatactacgcagactccgtgaaggccgattcaccatctccagggacaattccaggaacacggttttcttcaaatgaacaacctgagaggcgacgacacggccgtctattactgtgcgagacaagtcggcgctcggagtggttattattcgtttgacttctgggccagggaaccctggtcaccgtcgcctccgcctccacaagggcccatcggtcttcccctggcaccctcctccaagagcacctctgggggcacagcggccctgggctgcctggtcaaggactacttcctatatactgtctgagcgggcctggcaaggcgcatag

SEQ ID NO: 794377 - DNA, 655 bp, Homo sapiens
  misc_feature: 78916.44.12.B01.1.pb.heavy.1.raw 78916
cgtatcgcctccctcgcgccatcagacagtatatacacgaccggtgctcgatttagtagtgtagattccgcgggggctttctgagagtcatggacctcctgtgcaagacatgaagcacctgtggttcttcctcctgctggtggcggctcccagatgggtcctgtcccagctgcagctgcaggagtcgggccagactggtgaagccttcggagaccctgtccctcacctgcactgtctctggtggctccatcagcagtagtagttactactggggctggatccgccagccccagggaaggggctggagtggattgggagtatctattatagtgggagcacctactacaacccgtccctcaagagtcgagtcaccatatcagtagacacgtcaagaaccagttctcctgaagctgagctctgtgaccgccgcggacacggccgtgtattactgtgcgagagtagggcagttcgtcaccaactactttgaccactggggccagggaaccctggtcaccgtctcctcagcctccacaagggcccatcggtcttcccctggcaccctcctccaagagcactctggggcacagcggccctgggctgcctggtcaaggactacttcctatatactgtctgagcgggctggcaaggcgcatag

SEQ ID NO: 794378 - DNA, 652 bp, Homo sapiens
  misc_feature: 78925.44.53.E09.1.pb.heavy.1.raw 78925
cgtatcgcctccctcgcgccatcagacagtatatacacgaccggtgctcgatttagagagagtgtgttgggtttggggggaagcacctgtggttcttcctctgctggtgcggctcccagatgggtcctgtctcagccgcagctgcgggagtcgggccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctggggccaaggaccacggtcaccgtctcctcatcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794379 - DNA, 613 bp, Homo sapiens
  misc_feature: 78942.44.36.D03.1.pb.heavy.1.raw 78942
ctatgcgccttgccagcccgctcagacagtatataggaaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcaccacccattctaatatcgttgagagagaacccagagatggtgcaggtcagcgtgagggtctctgtgggtttcaccagcacaggaccagactccttcaaggtgaccctgggacaagagacccaagagagatcgtgacgcagctaaatcgagcaccggtcgtgtatatactgtctgatggcgcgagggaaggcgatacg

SEQ ID NO: 794380 - DNA, 680 bp, Homo sapiens
  misc_feature: 78959.44.35.D02.1.pb.heavy.1.raw 78959
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgagcaccggtcgtgtatatactggtctgatggcgcgagggaggcgatacg

SEQ ID NO: 794381 - DNA, 705 bp, Homo sapiens
  misc_feature: 78979.UNK.UNK.UNK.pb.heavy.1.raw 78979
ctatgcgccttgccagcccgctcagacagtatataggaagtagtccttgaccaggcagcccagggccgctgtgccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcattttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaaactccatggtgagtcctctgtgttcagtgctgatcaccgaatggaaacacctcggaatcccagtgctgggctcctctccccaaacccaacgtgcgagtgctaaatcgagcaccgtcgtgtatatactgtctgatgggcgcggagggaggcgatacg

SEQ ID NO: 794382 - DNA, 679 bp, Homo sapiens
  misc_feature: 78996.44.53.E09.1.pb.heavy.1.raw 78996
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgagacacagccgtctattactgtctgggatggtttcattcgggccagggaaccctggtcaccgtctcctcagcctccaccaagggccccatcggtcttcccctggcgccctgctccaggagcacctccgagagcacagcggccctgggctgcctggtcaaggactacttcctatatactgtctgagcgggctggcaaggcgcatag

SEQ ID NO: 794383 - DNA, 703 bp, Homo sapiens
  misc_feature: 79002.44.55.E11.1.pb.heavy.1.raw 79002
cgtatcgcctccctcgcgccatcagacagtatatacacgaccggtgctcgatttagcactcgcacgttgggtttggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 794384 - DNA, 721 bp, Homo sapiens
  misc_feature: 79046.UNK.UNK.UNK.pb.heavy.1.raw 79046
cgtatcgcctccctcgcgccatcagacagtatatacaacgaccggtgctcgatttagcagacgtctgaacacacaaaggggagctctgggagaggagccccagccgtgagattcccaggagtttccacttggtggatcagcactgagcacagaccaccaaccattggagtttgggctaatcttgattttccttgtagttttttttagaaggtgtccagtgcgaggggcgactggcggagtcgggggggggcttggcacagccaggggcggtctctgagactctctgtgtagtctcaggattcagtcttagtgattatcacttggcctgggtccgtcaggctccagggaaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactggcgccaggcgatcctgggacgtcgatgcatttgatatttggggccaggggacaatggtcaccgtctcttcagctccaccaagggcccatcggtcttcccccctggcgccctgctccaggagcacctctgggggcacagcggccctgggctgcctggtcaaggactacttcctatatactgtctgagcgggctggcaaggcgcatag

SEQ ID NO: 794385 - DNA, 699 bp, Homo sapiens
  misc_feature: 79051.44.55.E11.1.pb.heavy.1.raw 79051
cgtatcgcctcctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggacttttaaaaggtgtccagtgtgagtgcggctgatggagtctggaggaggcttagtccagcctgggggtccagagactctcctgtgcagcctctgggctcaccgtcagcagcaactacatgagttgggtccgccaggctccaggaaggggctggagtgggtctcagtcatttatactggtgatttcacatactacgcagactccgtgaagggccgattcaccatctccagggacaattcaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaaggggccatcggtcttccccctggcaccctcctccaagagcacctctgggggcacagcggccctgggctgcctggtcaaggactacttcctatatactgtctgagcgggctggcaaggcgcatag

SEQ ID NO: 794386 - DNA, 610 bp, Homo sapiens
  misc_feature: 79073.UNK.UNK.UNK.pb.heavy.1.raw 79073
ctatgcgccttgccagcccgctcagacagtatataggagtagtccttgaccaggcagcccagggcgctgtgccccagaggctgctctggggcagggcgcaggggaagaccgatgggccccttggtggaagctgaggagacagtgaccagggtgccacgccgccagtagatgaaagaccagtccgcgcctcgcacagaataaacgggcgtgtccgcgcggtcacggagtcagtcttccagggagaagcggttcatggacgtgtccctcgaaatggtgagacgacctctggtgaggacggagagtagtacgtcgcccagtataatggatgtcaccaatccactccattcccctcctggggctgccggatccagccccagaatgatcagaatgatggaaactccagagacagtgcagatgagagacagggttccgaagcctcacagtccctgggccgactcctgcagctgcacctgggacagggacccatctgggagctgccaccagaggaggaaaaccacaggtgttcaccctgccccaatccctaatcacgtgtactaaatcgagcacggtcgtgtatatactgtctgatggcgcgagggaggcgatacgc

SEQ ID NO: 794387 - DNA, 715 bp, Homo sapiens
  misc_feature: 79080.UNK.UNK.UNK.pb.heavy.1.raw 79080
ctatgcgccttgccagccccgctcagacagtatataggaagtagtccttgaccaggcaggcccagggccgctgtggctctcggaggtgctcctggagcagggcgccagggggaagaccgatgggcccttggtggaggcctgaggagacggtgaccagggttccctggccccagtggacagttcctgatataaacacaacacaataatacatgccccgtgtcctcggttttcaggtttagtcattcgcagaatcaatgagttcttgaagtcatctctttgagagggtgaatctggctttccacagacgccggcgtactcttgtgataagctggcaactttgtttttaactgcgcgccaaggccactccagccccttccctggagcctggcggaccccagtcatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaaacacctgggaattctggggctggggctccgctctcccccaagagagatcgtgacgcagctaaatcggagcaccggtcgtcgtgtatatactgtctgatggcgcgagggaggcgatacg

SEQ ID NO: 794388 - DNA, 687 bp, Homo sapiens
  misc_feature: 79108.UNK.UNK.UNK.pb.heavy.1.raw 79108
gcgccttgccagcccgctcagacagtatataggaagtagtccttgaccaggcagcccagggccgctgtgctctcggaggtgctcctggagcagggcgccagggggaagaccgatgggcgcccttggtggaggctgaggagacggtgaccagtgtcccctggcccccagtgaaacgcccgataatagctgctgccacttcccgatctcgcacagtaatacagagccgagtcctcggcctctcaggctgatcatttccaggtacagagtgttccgggaaattgtctctggagatggtgaatcggcccttcacggagtctgcataatatctagaagttccatcatatgctataactgccaaccactccggcccttgcctggagcctggcggacccagtgcatgccagaactactgaaactaaatccagaggcttcacaggagagtctcagggacctccaggctggaccacgcctcccccagactccaccaggtgcacctgacactggacacctcttaaaagagtaacgaggaaaacccagctcagcccaaaactccatggtgagtcctctgtgttcagtgctgatcaccgaatggaaacaccgccgagagcacagcggccctgagcgtagagctaaatcgagcaccgggtcgtgtatatactgtctgatggcgcgagggagggcgatacg

SEQ ID NO: 794389 - DNA, 658 bp, Homo sapiens
  misc_feature: 79112.UNK.UNK.UNK.pb.heavy.1.raw 79112
cgtatcgcctccctcgcgccatcagacagtatatacacgaccggtgctcgatttagtgctatgactgggtttggggatgctttctgagagtcaaggacctcctgtgcaagaacatgaagcacctgtggtttttcctcctgctggtggcagctcccagaggggtcctgtcccaggtgcagctgcagagtcgggcccaggactggtgaggccttccggggaccctgtctctcatctgccactgtctctggagtttccatcagttctgatcttcttgggggctggatccggcagcccccagggaggggaagtggagtggattggtgacatccattatactcggggccgacgtactactctccgtccctcaaaggtcgtctcaccatttcgaggacacgtccatgaaccgcttctccctgaaactgacctccgtgaccgccgcggacacggccgtttatttctgtgcgaggcgagactgggtctttcatctatgggggagccgtggcaccctggtcactgtctcctcagcttccaccaagggccccatcgtcttcccctggcgccctgctccaggagcacctctgggggcacagcggcctgggctgcctggtcaaggactacttcctaatatactgtctgagcgcggctggcaggcgcatag

SEQ ID NO: 794390 - DNA, 724 bp, Homo sapiens
  misc_feature: 79126.UNK.UNK.UNK.pb.heavy.1.raw 79126
tctatgcgccttgccagcccgctcagacagtatataggaagtagtccttgaccaggcagcccagggccgctgtgctctcggaggtgctcctggagcagggcgccagggggaagaccgatgggcccttggtggaggccgaggagacggtgaccagggttccctggccccaggccgtcgaatgaaccgattttgggaaacagatagtctcgcacaaaaatacacggccgtgtcctgaaggtctcaggctgttcatttgaagagacactgtgttctcggaattgtctctggagatggtgaatcggccctcaacggaatcaccgtagacttgatttcctccatgaaatgacacacctgccaccccactccaggccctcgcctggagcctgggcggacccactgcatattccaattatcgaaggtgaatccagaggctgcacagaagagtctcagggacccccctactggggccacggccttcccccagactcccacgaattgcacctggacacatgacacctcttaagaggggcaacgaggaaaacccagctcagcccaaactccatgggtgagtccctctgtgttcagtgatgatcaccgagtggaaacaccggcgacttccggagtgctgggctcgtctcccaggccccaaaacccttcgatcgcggtctaaatcggagcaccggtcgtgtatatactgtctgatgcgcgaggggaggcggatacg

SEQ ID NO: 794391 - DNA, 695 bp, Homo sapiens
  misc_feature: 79140.44.73.G07.1.pb.heavy.1.raw 79140
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttcctggccccagtagtcaagcggggaccgtctcgagggggctctcgcacaataatagacagccgtgtcctcacttgtgagttgtacatttgcagatgcagtgtgttcctggaattgtctctggagacggtgaatcggcccttctcggagtctccgtagtgttcttcaattccatcttctgatataattgccacccactccagccccttgcctggagcctggcggacccagtgcatggcataggtcctgaagatgaatccagaggcctgcacaggagagtctcagggagttccccaggctgggccgctcctcccaccaggactccactagctgcacctgacactggccacctcttaaaagagcaacgaggaaaaacccatctcagcccaaagtccatggtgagtcctctgtgttcagtgatgatcaccgatggaaacaccggcgacttcagtgctgggcctcgtctccccccctgagcgtagagctaaatcgagcaccggtcgtgtatatactgtctgatggcgcgagggaggcgatacg

SEQ ID NO: 794392 - DNA, 698 bp, Homo sapiens
  misc_feature: 79146.44.36.D03.1.pb.heavy.1.raw 79146
ctatgcgccttgccagccgctcagacagtatataggaagtagtccttgaccaggcagcccagggccgctgtgctctcggaggtgctcctggagcagggcgccaggggaagaccgatgggcccttgtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagcccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctgggctccgctctcagagctccccaagagagatcgtgacgcagctaaatcgagcaccggtcgtgtatatactgtctgatggcgcgagggaggcgatacg

SEQ ID NO: 794393 - DNA, 703 bp, Homo sapiens
  misc_feature: 79151.UNK.UNK.UNK.pb.heavy.1.raw 79151
ctatgcgccttgccagcccgctcagacagtatataggaagtagtccttgaccaggcagcccagggccgctgtgctctcggaggtgctcctgggagcagggcgccagggggaagaccgatgggcccttggtggaggctgaggagacggtgaccagggttccctgacccccagtagtcaatgagccaccccagcgcctcccgcacaataatacacagccgtgtcctcgactctcagactgttcatttgcagatacagtgagttcttggcgttgtctctggagatggtgaatcggcccttcacagagtccacatagtgtgtctcagttccatctttcttcatgatggccacccactccagccccttccctggaggcctgggcggaccccgagttgcatccaataactactaaaggtgaatccagaggctgcacaaggagagtctcagggaccccccaggctggaccaagcctccccagactccaccagttgcacctcacactggacaccttctaaaatagcaacaaggaaaacccagctcagtcccaattccatggtgagggtcctctgtgctcagtgctgatcaccaagtggaaaggccttggagtccagggctaaggctcctctctcccctttcccttgcagtcgtagtaatcgagcaccgtccgtgtatatactgtctgatggcgcgaggggaggcgataccg

SEQ ID NO: 794394 - DNA, 651 bp, Homo sapiens
  misc_feature: 79152.UNK.UNK.UNK.pb.heavy.1.raw 79152
ctatgcgccttgccagcccgctcagacagtatataggaagtagtccttgaccaggcagcccagggccgctgtgcccccagaggtgctcctggagcagggcgccagggggaagaccgatgggccctgggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgcccagtataatggatgtcaccaatccactccattccctccctgggggctgccggatccagccccaagaatgatcagaactgatggaaactccagagacagtgcagatgagagacagggttcccgaaggcctcaccagtcctggccgactcctgcagctgcacctgggacaggacccatctggagctgccacagcaggaggaaaaaaccacagtgcttcatgttcttgcacaggaggtccttgactctcgaaagcatccccaaacccaagtctatagcactaaatcgaggcaccggtcgtgtatatactgtctgatggcgcgaggagagcgagatacg

SEQ ID NO: 794395 - DNA, 612 bp, Homo sapiens
  misc_feature: 79166.UNK.UNK.UNK.pb.heavy.1.raw 79166
ggaaaggtgggcaggctatgcaccctggtccaggtcaaaagctgcgggaacccggctagcggccatcttggccactaggggtcccgcagattcatattgtcgttctagcatgcacaatgctgcaaaccagcttgccaatgccccacagcaagcggccaaatctttacgccacgttgaattgtttattactgtgactggctatggcttgcaacgccactcgtaaaaactagtactttgcggttaggggaagtagacaaacccattactccacttcccggaagttcaaactcattccaacacgaaataaaaggtaaaactcaacacccccaagcaggctattggggggggtgatagggtgattctatttcctatcccatccctaggatctcaattaagttactaggagttaaatgtctgtagcgatcccgtcagtcctatcggcgcatcaagacctggttggttgagcgtgcagtagatcatcgataaagctgcgagttaggtcatccagaccgcatctggcgcctaaacgttcagtggtagctaaggccgtcactcgactgtctaaaggcaatatgtcgtccttagctccagatcctagcaagcggtgtcggg

SEQ ID NO: 794396 - DNA, 709 bp, Homo sapiens
  misc_feature: 79179.UNK.UNK.UNK.pb.heavy.1.raw 79179
cgtatcgcctccctcgcgccatcagacaggtatatacacgaccggtgctcgattagctgctgcgtcacgatctctcttggggagctctgagagcggagccccagccccagaattcccaggtgttttcatttggtgatcagcactgaacacagaggactcaccatgggagttcggctgagctgggttttccttgttgttattttacaaggtgtccagagtgaagtgcagttggtggagtccgggggagacttggtccagcctggagggtccctgagactctcctgtgtcgcctctggatttcaccatcagtgaccactatatggactgggtccgccaggctccagggaaggggctggagtggcttggccgcagtaaaaacaaagttgccagctttatcacagagtacgccgcgtctgtgaaagccagatttcaccctctcaaagaatgacttcaagaactcattgatctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794397 - DNA, 599 bp, Homo sapiens
  misc_feature: 79184.UNK.UNK.UNK.pb.heavy.1.raw 79184
gaaggctgggcaggctatgcaccctggtccaggtcaaaagctgcggaacccgctagcggccatcttggccactaggggtccgcagatttcatattgtcgtctagcatgcacaatgctgcaaaccagcttgcaatgccacagcaagcggccaatctttacgccacgttgaattgtttattacctgtggactggctatggcttgcaacgccactcgtaaaactagtactttgcggttagggggagtagacaaacccattactccacttccggaagttcaactcattccaacacgaaataaaagtaaactcaacaccccaagcaggctatgtgggggggtgataggggtggattctatttcctatcccatccctaggatctcaattaagttactagcgagttaaatgtctgtagcgatcccgtcagtcctatcgcgcgcatcaagaccggttggttgagcgtgcagtagatcatcgataagctgcggttaggtcatccagaccgcatctggcgcctaaacgtcagtggtagctaaggcgtcaccttcgactgtctaaaggcaatatgtcgtcttagctccaagtccctagcaagcgtgtcgg

SEQ ID NO: 794398 - DNA, 594 bp, Homo sapiens
  misc_feature: 79199.UNK.UNK.UNK.pb.heavy.1.raw 79199
ccgacacgcttgctagggacttggagctaaggacgacatattgcctttagacagtcgaaggtgacgccttagctaccactgaacgtttaggcgccagatgcgtctggatgacctaactcgcagcttatcgatgatctactgcacgctcaaccaaccaggtcttgatgcgcgcgataggactgacggatcgctacagacatttaactcgctagtaacttaattgagatcctaggggatggataggaaatagaatccaccctatcaccccccacatagcctgcttgggtgttgagtttacttttatttcgtgttggaatgagttgaacttccggaagtgagtaatgggtttgtctacttccctaaccgcaaagtactagttttacgagtggcgttgcaagcatagccagtcacaggtaataaacaattcaacgtggcgtaaagattggccgcttgctgtgggcattgcaagctgggtttgcagcattgtgcatgctagacgacaatatgaatctgcgggacccctagtggccaagatggcgctagcggttccgcagcttttgacctggaccagggtgcatagcctgcccagccttc

SEQ ID NO: 794399 - DNA, 597 bp, Homo sapiens
  misc_feature: 79201.UNK.UNK.UNK.pb.heavy.1.raw 79201
cccgacacgcttgctagggacttggagctaaggacgacatattgcctttagacagtcgaaggtgacgcttagctaccactgaacgtttaggccagatgcggtctgggatgacctaactcgcagcttatcgatgatctactgcacgctcaaccaaccaggtcttgatgcgcgcgataggactgacgggatcgctacagacatttaactcgctagtaacttaattgagatcctagggatgggataggaaatagaatccacccctatcacccccccacatagcctgcttggggtgtgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggcgctagcgggttccgcagcttttgacctgaccagggtgcatagcctgcccagct

SEQ ID NO: 794400 - DNA, 652 bp, Homo sapiens
  misc_feature: 79244.44.57.F02.1.pb.heavy.1.raw 79244
cgtatcgcctccctcgcgccatcagacagtatatacacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcggcccaggactggtgaggccttcgggaaccctgtctctcatctgcactgtctctggagtttccatcagttctgatcattcttggggctggatccggcagccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794401 - DNA, 544 bp, Homo sapiens
  misc_feature: 79251.44.43.D10.1.pb.heavy.1.raw 79251
cgtatcgcctcctcgcgccatcagacagtatatacacgaccggtgctcgatttagactagcagtaaggggctgaggtgaagaagcctgggcctcagtgaaggtctcctgcaagacttctggatacaccttcaccaattatgatatcaactgggtgcgacaggccactggacaagggcttgagtggatgggatggatgaaccctaacagtggtaacacaggctatgcacagaagttccaggcagagtcaccatgaccaggaacacctccataaacacagcctacatggagctgagcagcctgagatctgaggacacggccgtgtattactgtgcgagatcccgaaagtatagcagctcgtcgggaggtggttcgacccctggggccaggaaccctggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatag

SEQ ID NO: 794402 - DNA, 713 bp, Homo sapiens
  misc_feature: 79257.44.85.H08.1.pb.heavy.1.raw 79257
cgtatcgcctccctcgcgccatcagacagtatatacacgaccggtgctcgatttagtatcactcagtcgcggggctctgggagaggagcccagcactagaagtcggcggtgtttccattcggtgatcagcactgaacacagaggactcaccatggagtttgggctgagctggttttcctcgttgctcttttaagaggtgtccagtgtcaggtgcagctggtggagttctgggggaggcgtggtccagcctgggaggtccctgagactctcctgtgcagcgtctggattcaccttcagtacctatggcatgcactggtccgccaggctccaggcaaggggctggagtgggtggcacttatatggtatgatggaagtaataaatactatgcagactccgtgaagggccgattcaccatctccagagacattccaagaacacgctgtatctgcaaatgacagcctgagagccgaggacacgctgtgtattactgtgcgaggacatattgtagtactaccacctgctggactactactacggtatggacgtctggggccaagggaccacggtcaccgtctcctcagcctccaccaagggccatcggtcttccccctgcaccctcctccaagagcacctctgggggcacagcggccctggctgcctggtcaaggactacttcctatatactgtctgagcgggctggcaaggcgcatag

SEQ ID NO: 794403 - DNA, 613 bp, Homo sapiens
  misc_feature: 79266.UNK.UNK.UNK.pb.heavy.1.raw 79266
gaaggctgggcaggctatgcaccctggtccaggtcaaaagctgcggaacccgctagcggccatcttggccactaggggtcccgcagatttcatattgtcgtctagcatgcacaatgctgcaaacccagcttgcaatgccccacagcaagcgggccaatctttacgccacgttgaattgtttattacctgtgactggctatggcttgcaacgccactcgtaaaactagtactttgcggttaggggaagtagacaaaacccattactccacttcccggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagaccctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794404 - DNA, 655 bp, Homo sapiens
  misc_feature: 79274.44.57.F02.1.pb.heavy.1.raw 79274
cgtatcgcctccctcgggcgccatcagacagtatatacacgaccggtgctcgatttagctcgatatagttgcggtttgggatgctttctgagagtcaaggacctcctgtgcaagaacatgaagcacctgtggtttttcctcctgctgggtggcagctccagatgggtcctgtcccaggtgcgcagctgcaggagtcgggccaggagactggtgaggccttcgggaaccctgtctctcatctgcactgtctctggagtttccatcagttgatcattcttggggtggatcccggcagccccaggggaatggagtggattggtgacatccattatactggggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcaatctatgggccggtggcaccctggtcactgtctcctcagcttcccaccaagggccatcggtcttccccctggcgccctgctccaggagcacctctggggcacagcggccctggctgcctggtcaaggactacttcctatataatactgtctgagcgggctggcaaggcgcatag

SEQ ID NO: 794405 - DNA, 593 bp, Homo sapiens
  misc_feature: 79283.44.78.H01.1.pb.heavy.1.raw 79283
ctatgcgccttgccagcccgctcagacagtatataggaagtagtccttgaccaggcagcccagggccgctgtgctctcggaggtgctcctggagccagggcgccagggggaagaccgatgggccttggtggaggctgaggagacggtgaccagggttccctggccccacaagtcagccaggtgctggtggctctcgcacagaaatacaccggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcaccagctgtacctgggagtgggaccgtcagtcttcctcttccccccaaacccaaactactcacactaaatcgagcaccggtcgtgtatatactgtctgatggcgccgagggaggcgatacg

SEQ ID NO: 794406 - DNA, 736 bp, Homo sapiens
  misc_feature: 79304.UNK.UNK.UNK.pb.heavy.1.raw 79304
ctatgcgccttgccagcccgctcagacagtatatagaagtagtccttgaccaggcagcccagggccgctgtgcccccagaggtgctcttggaggagggtgccagggggaagacgatggccccttggtggaggctgaggagaccggcggaccgtggtcccttggccccaggcgtccataccattggagtagagcatgtcatatctgtatccacgagccccatctctcgcacagtagtagacagccgtgtcctcggctcttcaggctattcatttccagatatagttgtgttcttcgaattgtctctggagatggtgaaatcggcccttcacggaatctacataatatttattacttcccatcataccatataagtgccacccactccagtcccttgcctggagcctggcggacccagtgcatgccatgtctgtttgaaggtgaatccagacgctacacaggaagagtctcaggacctcccaggctggaccacgcctcccccagactccaccagcttcacctgaccactggacactcttaaaagagcaacgagaaaaacccaggtcagcccaaactccatggtgagtcctctgtgttcggtgctgatcaccgactggaaaacaccgccgacttctggtgctgggctcctctcccagagctccccaacccaagtctatagcactaaatcgagcaccggtcggtgtatatactgtctgatggcgcgagggaggcgatacg

SEQ ID NO: 794407 - DNA, 726 bp, Homo sapiens
  misc_feature: 79313.UNK.UNK.UNK.pb.heavy.1.raw 79313
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaattctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaagagcaacgaggaaaaacccaggtcagcccaaactccatggtgagtcctctgtgttcggtgctgatcaccgactggaaacaccgccgacttctggtgctggctcctctccagccccaaacccaacgagctcactctaaatcgagcaccggttcgtgtatatactgtctgatggcgcgagggaggcgatacg

SEQ ID NO: 794408 - DNA, 662 bp, Homo sapiens
  misc_feature: 79318.UNK.UNK.UNK.pb.heavy.1.raw 79318
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccagtggtcaaagtagttggtgacgaactgccctactctcgcacagtaatacacggccgtgtccgcggcggtcacagagctcagcttcagggagaactggttcttggacgtgtctactgatatggtgactcgactctgagggacgggttgtagtaggtgctcccactataatagatactcccaatccactccagccccttccctggggctggcggatccagccccagtagtaactactactgctgatggagccaccagagacagtgcaggtgagggacagggtctccgaaggcttcaccagtcctgggcccgactcctgcagctgcagctgggacaggacccatctgggagccgccaccagcaggaggaagaaccacaggtgcttcatgttcttgcacaggaggtccatgactctcagaaagcccccgcggaatctacactaactaatcgagcaccgtcgtgtatatactgtctgatggcgcgagggaggcgatacg

SEQ ID NO: 794409 - DNA, 722 bp, Homo sapiens
  misc_feature: 79325.44.85.H08.1.pb.heavy.1.raw 79325
cgtatcgcctccctcgcgccatcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactggtccgccaggctccaggcaaggggctggagtgggtggcacttatatggtatgatggaagtaataaatactatgcagactccgtgaagggcccgattcaccatctccagagacaattccaagaacacgctgtatctgcaaatgaacagcctgagagccgaggacacggctgtgtattactgtgcgaggacatattgtagtactaccacctgctggactactactacggtatggacgtctggggccaagggacccacggtcaccgtctcctcagcctccaccaagggcccatcggtcttccccctggcacctcctccaagagcacctctggggcacagcggccctgggcctgcctggtcaaggactacttcctatatactgtctggagcgggctggcaaggcgcatag

SEQ ID NO: 794410 - DNA, 623 bp, Homo sapiens
  misc_feature: 79334.44.38.D05.1.pb.heavy.1.raw 79334
ctatgcgccttgccagcccgctcagacagtatataggaagtagtccttgaccaggcagccagggccgctgtgccccagaggtgctcctggagcagggcgccagggggaagaccgatggcccttggtggaagctgaggagacggtggaccgtgggtcccttggccccagacgtccatacccgtagtagtagtatggcaactccccgaactcccgcaccggctcttgcacagtaatacacagccgtgtcctcggctctcagactgttcatttgcagatacagcgtgttcttggcgttgtctctggagatggtgaatcggccctttcacggagtccgcgtagcttgtgctactcccatcactattaatacgtgagacccacaccagccccttcctctggagcttggcggaccagtggcatccagtagctactgaaggtgaatccagaggctgccacaggagagtctcagggaccccccccaggctgaactaagcctcccccgactccacagctgcacctcacactggacacccttttaaaatagcaacaaggaaaacccagctatcagatactaaatcgagcaccggtcgtgtatatactgtctgatggcgcggggaggcgatacg

SEQ ID NO: 794411 - DNA, 644 bp, Homo sapiens
  misc_feature: 79338.44.19.B08.1.pb.heavy.1.raw 79338
ctatgcgccttgccagcccgctcagacagtatataggaagtagtccttgaccaggcagcccagggccgctgtgctctcggaggtgctcctggagcagggcgccagggggaagaccgatgggcccttggtggaggctgatgagacggtgacctggattccctggccccagggttcgaagaagcccgtggtcattgtggtcatgaagtgggcacagaaatatgtgcctgtgtccacagggtcacgttggtcaatgtaaggaccacctggtttttggacgtgtccttcgtgagcgtgagtctgtcgtcagagaaggactatatcgtatatcgtcattccaataagtgagtgcgatccactccagggcctttccggggggctgccgcacccagacaacgccctctccaggagtgacgagtgagaagcctgagacggtgcaggtcagcgtgagggtctgtgtgggtttcaccaatgtagggccagactctttcacggtgatctgggacaggcccatgaagggatggtcagcagcaggagcgtggagcaaagtgtgtccatggtggggcacaggagtccccccttactgactcactaaatcgagcaccggtcgtgtatatactgtctgatggcgcgagggaggcgatacg

SEQ ID NO: 794412 - DNA, 710 bp, Homo sapiens
  misc_feature: 79346.44.27.C05.1.pb.heavy.1.raw 79346
ctatgcgccttgccagcccgctcagacagtatataggaagtagtccttgaccaggcagcccagggccgctgtgctctcggaggtgctcctggagcagggcgccagggggaagaaccgatggcccttggtggaggccgaggagacggtgaccagggtttccctggccccaggcgtcgaatgaacccgattttggaaacagatagtctcgcacaaaaatacacggccgtgtcctgaggtctcagggctgttcatttgaagagacactgtgttctcggaattgtctctggagatggtgaatcggccctcaacggaatcaccgtagacttgatttcctccatgaaatgacacacctgccaccactccagcccctcgcctggagcctggcgggacccactgcatattccaattatcgaaaggtgaatccagaggctgcacaggagagtctcagggacccccctactggggccacgcctccccagactccacgaattgcacctgacacatgacacctcttaagaaggcaacgaggaaaacccagctcagcccaaaaactccatggtgagtcctctgtgttcagtgatgatcaccgagtggaaacaccggcgacttccagtgctgggcttcgtctcccagcccaacccttcgatcgcgtctaaatcgagcaccggtcgtgtatatactgtctgatggccggcgagggaggcgatacg

SEQ ID NO: 794413 - DNA, 683 bp, Homo sapiens
  misc_feature: 79350.44.27.C05.1.pb.heavy.1.raw 79350
cgtatcgcctccctcgcgccatcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcata

SEQ ID NO: 794414 - DNA, 709 bp, Homo sapiens
  misc_feature: 79366.44.55.E11.1.pb.heavy.1.raw 79366
cgtatcgcctccctcgcgccatcagacagtatatacacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggactttaaaaaggtgtccagtgtgaggtgcggctgatggagtctggaggaggcttagtccagcctgggggtcccaggagactctcctgtgcagcctctgggctcacgtcagcagcaactacatgagttgggtccgccaggctccagggaaggggctggagtggggtctcagtcatttatactggtgatttcacatactacgcagactccgtgaagggccgattcaccatcccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccacaagggcccatcgtcttcccccctgggcaccctcctccaagagcacctctgggggggcacagcggccctgggctggcctggtcagaggactacttcctatatactgtctgagcgggctggcaaggcgcatag

SEQ ID NO: 794415 - DNA, 726 bp, Homo sapiens
  misc_feature: 79394.44.39.D06.1.pb.heavy.1.raw 79394
ctatgcgccttgcccagcccgctcagacagtatataggaagtatccttgaccaggcagcccagggcgctgtggcccccagaggtgctcctggagcagggcgccaggggaagaccgatgggccctggtggaagctgaggagacggtgaccgacgtccccctgccccagacatccatcaaatagtagtagtttatgattcccgaaccgtttccttggaggtccccctcgcacagtaataaacagacgtgtcgtcaactctcacgctgttcatttgcaaatacagcatattcttggaattgtctctggagatggtgaatcggcccttcacggagtctgagtaatacttctcacttccatcgtcggagatggactgccacccactccggccccttgcctggagcctggcggaccagtgcaaaccaaatctatcgaatgagaacccagaggctacacaggagagtctcagggacctcccgggctggaccacggcctcccccagactccaccaagtgctcctgacactggacacctcttaaaagagcaacgaggaaaacccagctcagcccaaactccatggtgagtcctctgtgttcagtgatgatcaccgaatggaaacaccggcgacttccagtgctgggctcgtctctcccccaaagaactgcgagatgtcactaaatcgagcaccggtcgtgtatatactgtctgatggcgcgagggaggcgatacg

SEQ ID NO: 794416 - DNA, 705 bp, Homo sapiens
  misc_feature: 79401.44.55.E11.1.pb.heavy.1.raw 79401
ctatgcgccttgccagcccgctcagacagtatataggaagtagtccttgaccaggcagcccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgagataaaccgtgttcctggaattgtccctggagatggtgaatcggcccttcacggagtctgcgtagtatgtgaatccaccagtataaatgactgagacccactccagccccttccctggagcctggcggacccacccatcatgtagttgctgctgacggtgagcccagaggctgcacaggagagtctctggaccccccaggctggactaagcctcctccagactccatcagccgcacctcacactggaacaccttttaaaagtccaacaaggagaacccagctcagccaaaactccatggtggagtcctctgtgttcagtgctgatcaccgaatggaaacacctcggaatcccagtgctgggctcctctcccccaaacccaacgtgcgagtgctaaatcgagcaccggtcgtgtatatactgtctgatggcgcgagggaggcgatacg

SEQ ID NO: 794417 - DNA, 704 bp, Homo sapiens
  misc_feature: 79405.44.36.D03.1.pb.heavy.1.raw 79405
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacacaaaggaaaacccagctcagcccgaactccatggtgagtcctctgtgttcagtgctgatcaccaaatgaaaacacctgggaattctgggctggggctccgctctcagagctccccaagagagatcgtgacgcagctaaatcgagcaccggtcgtgtatatactgtctgatggcgcgagggaggcgatacg

SEQ ID NO: 794418 - DNA, 608 bp, Homo sapiens
  misc_feature: 79409.UNK.UNK.UNK.pb.heavy.1.raw 79409
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaaactcgctagtaacttaattgagatcctaggggatgggatagggaaatagaatccacccctatcacccccccacatagcctgcttggggtgttgagtttacttttatttcgtgttggaatgagttgaacttccgggaagtggagtaatgggtttgtctacttccctaaccgcaagtactagtttacgagtggcgttgcaagccatagccagttcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794419 - DNA, 635 bp, Homo sapiens
  misc_feature: 79412.44.36.D03.1.pb.heavy.1.raw 79412
cgtatcgcctcctcgcgccatcagacagtatatacacgaccggtgctcgatttagctgcgtcacgatctctctggggagagcggagccccagccccagaattcccaggtgttttcattggtgatcagcactgaaacagaggactcaccatggagtcggctggctgggttttcctgttgttattttacaagtgtccagagtgagtgcagttggtggagtccggggagacttggtccagcctggagggtccctgagactctcctgtgtcgctctggattcaccatcagtgacacttatggactggtccgcagctccaggaaggctggtggcttggcgcagtaaacaaagttgccacttgatcacagagtacgcgcgtctggaaagccagattcaccctctcaagaatgactcagaactcattgattctgcgaatgactaacctgaaaccgaggaccggcatgtattatttgttgtgtttatatcaggactgtcactggccagggaacctggtcaccgtctcctcagctccacaagggccatcgtcttccctgcgcctgctcagagcacctcgagcacagcggcctgctgctggtcaaggactacttcctatatacgctgagcgggctgcaggcatag

SEQ ID NO: 794420 - DNA, 739 bp, Homo sapiens
  misc_feature: 79416.UNK.UNK.UNK.pb.heavy.1.raw 79416
ctatggccttgcagcccgctcagacacagtatataggaaagtagtccttgaccaggcagcccagggccagctgtgctctcggaaggtgctcctggagcagggcgccagggggaagaccgatgggcccttggtggaggctgaggagacggtgaccagggttccctggccccgaatgaaaccatcccagacagtataaaggtctgctggtgtcctcgggtgttcaggctgttcatctgcagagacatccgtatcttttgaatcatctcttgaatgatggtaatctgcctttcacgggtgcagcgtgtagcctgcatgttcccaccgtcagctttggttctaatacggcaacgccaactccagccccttccctggagcctgcgcggacccaggtcatccaggcgttactgaaagtgaatccagaggcgcacaggagaagtctaagggactccccaggctttaccaaacctcccccagactccaccaactgcacctcacactggacacttttaaaatagcagcaaggaaaatccagctcagcccaaaactccatgcggctgacgtcctctgtgtttcatgtccttgatccctgacatgaaaaacctgggaaatccccagcggctggggctcctcttccagagcttcaaccacctctatgagccacggtcgcctgctctaaatcgagtcgactacgggtcgtgtatgactggccggagcgtctacgggggagggaggcgatacg

SEQ ID NO: 794421 - DNA, 715 bp, Homo sapiens
  misc_feature: 79425.44.86.H09.1.pb.heavy.1.raw 79425
cgtatcgcctccctcgcgccatcagacagtatatacacgaccggtgctcgatttagtgctatagacttgggttgggagctctgggagaggagcccagcaccagaagtcggcggtgtttccagtcggtgatcagcacgaacacagaggactcaccatggagtttggctgacctgggtttcctcgttgctcttttaagaggtgtccagtgtcaggtgaagctggtggagtctgggggaggcgtggtccagcctgggaggtcctgagactctcctgtgtagcgtctggattcaccttcaacagacatggcatgcactggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacgctgtctactactgtgcgagagatgggctcgtggatacagatatgacatgctctactccaatggtatggacgcctgggccaagggaccacgtcgccgtctcctcagcctccaccaagggcccatcggtcttccccctggcaccctcctccaagagcacctctggggcacagcggccctggctgcctggtcaaggactacttctatatactgtctgagcggctggcaaggcgcatag

SEQ ID NO: 794422 - DNA, 713 bp, Homo sapiens
  misc_feature: 79427.44.62.F07.1.pb.heavy.1.raw 79427
cgtatcgcctccctcgcgtcatcagacagtatatacacgaccggtgctcgatttagtagtcgcataaaggggaaaggggagctctgagagaggagcccagccctgggattttcaggtgtcttcatttggtgaccaggaccgaacagagagaagtctccatggagtttgggctgagctgcctttttcttgtggctttttttaaagggtgtcgtgtgtgaagtgcagttgttggagtctggggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgacccccatgacacctttagtacttggggccgggggacagtggtgaccgtctcttcagcctccaccaagggcccatcggtcttcccctggcgccctgctccaggagcacctccgagagcacagcggccctgggctgcctggtccaaggactacttcctatatactgtctgagcgggctggcaaggcgcatag

SEQ ID NO: 794423 - DNA, 608 bp, Homo sapiens
  misc_feature: 79443.UNK.UNK.UNK.pb.heavy.1.raw 79443
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccgggaagtggagtaatggtttgtctacttcccctaaccgcaaaagtactagtttacgaggtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcggttccgcagcttttgacctggaccaggggtgcatagcctggcccagccttc

SEQ ID NO: 794424 - DNA, 706 bp, Homo sapiens
  misc_feature: 79482.44.36.D03.1.pb.heavy.1.raw 79482
cgtatcgcctccctccgcgcatcagacagtatatacacgaccggtgctcgatttagctgcgtcacgatctctctttggggagctctgagagcggagccccagccccagaattcccaggtgttttcatttggtgatcagcactgaacacagaggactcaccatggagttcgggctgagctgggggttttccttgttgttattttacaaggtgtccagagtgaagtgcagttggtggagttccggggagacttgtccagcctggagggtccctgagactccccccgtgtcgcctctggattcaccatcagtgaccactatatggactgggtccgcgcaggctccagggaaggggctgggagtggcttggccgcagtaaaaacaagttgccagctttatcacggtacgccgcggtctgtgaagccagattcacccttcaagaagatgacttttcaagaactcattgattctgcgaatgactaacctgaaaaaaccgaggacacgggcatgtattattgtgttgtgtttatatcaggaactgtccactggggccagggaaccctggtcaccgtctctcagcctccaccaagggcccatcggtcttcccctggcgccctgtccaggagcacctccgagagcacagcggccctgggcgcctggtcaaggactacttcctatatactgtctgagcgggctggcaggcgcatag

SEQ ID NO: 794425 - DNA, 698 bp, Homo sapiens
  misc_feature: 79489.44.36.D03.1.pb.heavy.1.raw 79489
tgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctcccaagagagatcgtgacgcagctaaatcgagcaccggtcgtgtatatactgtctgatggcgcgagggaggcgatacg

SEQ ID NO: 794426 - DNA, 705 bp, Homo sapiens
  misc_feature: 79495.44.27.C05.1.pb.heavy.1.raw 79495
cgtatcgcctccctcgcgccatcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggtttcctcgttgccctcttaagaggtgtcatgtgtcaggtgcaattcgtggagtctgggggaggcgtggccccagtaggggcggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaaggcccatcggtcttcccctggcgccctgctccaggagcacctccgagagcacagcggccccgggctgcctggtcaaggactacttcctatatactgtctgagcgggctgcaaggcgcatag

SEQ ID NO: 794427 - DNA, 595 bp, Homo sapiens
  misc_feature: 79504.44.78.H01.1.pb.heavy.1.raw 79504
ctatgcgccttgccaagcccgctcagacagtatattaggaagtagtccttgaccaggcaggcccagggccgctgtgctctcggaggtgctcctggagctagggcgccagggggaagaccgatgggcccttggtggaggctgaggagacggtgaccagggttccctggccccacaagtcaagcccaggtgctggtggctctcgcaacagaaatacacggccgtgtcctcagatctcaggctgctcagttccatgtagactgtacctggggaggtgctcctggtcatactaactctgccttgaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagccccagactgcacagctgtacctgggagtgggaccgtcagtcttcctcttcccccaaaccaaactactcacactaaatcgagcaccggtcgtgtatatactgtctgatggcgcgacgggaggcgatacg

SEQ ID NO: 794428 - DNA, 662 bp, Homo sapiens
  misc_feature: 79513.44.12.B01.1.pb.heavy.1.raw 79513
cgtatcgcctccctcgcgccatcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttcccctggcaccctcctccaagagcacctctgggggcacagcggcctgggctgcctggtcaaggactacttcctatatactgtctgagcgggctggcaaggcgcatag

SEQ ID NO: 794429 - DNA, 709 bp, Homo sapiens
  misc_feature: 79519.44.36.D03.1.pb.heavy.1.raw 79519
ctatgcgccttgccagcccgctcagacagtatataggaagtagtccttgaccaggcagcccagggccgctgtgctctcggaggtgctcctggagcagggcgccagggggaagacccgatgggcccttggtggaggctgaggagacggtgaccagggttccctggcccagtggacagttcctgatataaacacaacacaataatacatgcccgtgtccctcggttttcagttaggtcattcgcagaatcaatgagttcttgaagtcatctcttgagagggtaatctggctttcacagacgcggcgtactctgtgataaagctggcaactttgtttttttactgcggccaagccactccagccccttccctggagcctggcggacccagtccatatagtggtcactgatggtgaatccagaggcgacacaggagagtctcaggaccctccaggctggaccaagtctcccccggactcccaccaactgcacttcactctggacaccttgtaaaaataacaacaaggaaaacccagctcagcccgaactccatggtgagtcctctgtgttcagtgctgatcaccaaatgaaaacacctgggaattctggggctggggctccgctcttcagagctccccaagagagatcgtgacgcagctaaatcgagcaccggtcgtgtatatactgtctgatggcgcgagggaggcgatacg

SEQ ID NO: 794430 - DNA, 696 bp, Homo sapiens
  misc_feature: 79528.44.67.G01.1.pb.heavy.1.raw 79528
cgtatcgcctccctcgcgccatcagacagtatatacacgaccggtgctcgatttagagtatacatattggtttggggggagaggagccagcactgggatccgaggtgtttccattcgtgatcagcactgaacacagaggactccaccatggagttttggctgagctgggttcccttgttggacttttaaaaggtgttcagtgtgaggtgcggctgatggagtctggaggaggcttagtccagcctggggggtccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggaccaattccaggaacacggtttatcttcaaatgaacaacctgagagcgacgacacggccgtctattactgtgcgagacaagtcggcgctcggagtggttattattcgtttgacttctgggccaggaaccctgtcaccgtcgcctccgcctccaccaagggcccatcggtcttcccctggcaccctcctccaagagcacctctgggggcacagcggccctgggctgcctggtcaaggactacttcctatatactgtctgagcgggctggcaaggcgcatag

SEQ ID NO: 794431 - DNA, 709 bp, Homo sapiens
  misc_feature: 79538.44.55.E11.1.pb.heavy.1.raw 79538
cgtatcgcctccctcgcgccatcagacgagtatatacacgaccggtgctcgattttagcactcgcacgttgggtttggggagaggagcccagccactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtccagagactctctgtgcagcctctgggctcaccgtcagcagcaactacatgagtttggttccgccaggctccagggaaggggctggagtgggtctcagtcattttatactggtgatttcacatactaacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaacccctggtcaccgtcgcctccgcctccaccaagggcccatcggtcttccccctggcaccccctctccaagagcacctctggggcacagcggccctgggcctgcctggtcaaggactacttcctatatactgtctgagcgggctggcaaggcgcatag

SEQ ID NO: 794432 - DNA, 611 bp, Homo sapiens
  misc_feature: 79542.UNK.UNK.UNK.pb.heavy.1.raw 79542
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccgggaagttcaactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgccgcatcaagacctggttggttgagcgtgcagtagatcatcgataagctgcgagttaggtcatcccagaccgcatctggccgcctaaacgttcagtggtagctaaggcgtcaccttcgactgtctaaaggcaatatgtcgtccttagctccaagtccctagcaagcgtgtcggg

SEQ ID NO: 794433 - DNA, 665 bp, Homo sapiens
  misc_feature: 79556.44.12.B01.1.pb.heavy.1.raw 79556
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaaccgtccctcaagagtcgagtccaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794434 - DNA, 608 bp, Homo sapiens
  misc_feature: 79561.UNK.UNK.UNK.pb.heavy.1.raw 79561
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtacttttgcggttagggagtagacaaacccattactccacttcccggaagttcaactcattccaacacgaaataaaagtaaactcaacacccccaagcaggctatgtgggggggtgataggggtggattctattcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctgcgcctaaacgttcagtggtagctaaggcgtcaccttcgactgtcttaaaggcaatatgtcgtccttagctccaagtcccctagcaagcgtgtcggg

SEQ ID NO: 794435 - DNA, 712 bp, Homo sapiens
  misc_feature: 79564.UNK.UNK.UNK.pb.heavy.1.raw 79564
cgtatcgcctccctcgcgccatcagacagtatatacacgaccgggtgctcgatttagcagacgtctgaacacacaaaggggagctctgggagaggagcccagccgtgagattcccaggagtttccactggtgatcagcactgagcacagaccaccaaccatggagtttgggctaatcttgattttccttgtagtttttttagaaggtgtccagtgcgaggggcgactggcggagtcgggggggggccttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccacaagggcccatcggtcttccccctggcgccctgctccaggagcacctctggggcacagcggccctgggctgcctggtcaaggactacttcctatatactgtctgagcggctggcaaggcgcatag

SEQ ID NO: 794436 - DNA, 634 bp, Homo sapiens
  misc_feature: 79572.44.23.C01.1.pb.heavy.1.raw 79572
ctatgcgccttgccagcccgctcagacagtatatataggaaagtagtccttgaccaggcagcccagggccgctgtgcccccagaggtgctcctggagcagggcgccaggggaagaccgatgggcccttggtgggaagctgaggagacagtgaccagggtgccaacggccccatagattgaaagaccagtcttcgcctcgcacagaaataaacggccgtgtccgcggcggtcacggaggtcagtttcagggagaagcggttcattcggacgtgtccctcgaaaatggtgagacgactcttgagggacggaagagtagtacgtcgccccagtataatggatgtcaccaatccactccattcccctccctggggctgccggatccagccccaagaatgatcagaaactgatggaaactccagagaacagtgcagatgagagacagggttccccgaaggcctcaccagtcctgggcccgactcctgcagctgcacctgggacaggaacccatctgggagctgccaccagcaggaggaaaaacccacaggtgttcaccctgccccaatccctaatcacgtgtactaaatcgagcaccggtcgtgtatatactgtctgatggcgcgagggaggcgatacg

SEQ ID NO: 794437 - DNA, 711 bp, Homo sapiens
  misc_feature: 79587.44.36.D03.1.pb.heavy.1.raw 79587
ctatgcgccttgccagcccgctcagacagtatataggaagtagtccttgaccaggcagcccaggccgctgtgctctcggaggtgctcctggagcagggcgccagggggaagaccgatgggcccttggtggaggctgaggagacggtgaccagggttccccggccccagtagtcaaaaccagccactgaccaagtggcccgatctctcgaacagaagtagacagccgtgtcctcgtctctcaggctgttcatttccagatacagtgagttcttggcattgtccctggaattggtgaatcggcccttcacagagtctgcgtagtaggtggtatctccagcaatattaacatatgaaacccactccagccccttccctggagcctggcggacccagttcatggcatagtcactgaagatgaatccagaggctgcacaggagagtctcagggacccccccgctgtacaagcctcccccagactccaccagccgcacctcacagtggacaccttctaaatagcaacaaggaaaacccagcgcagccccaactccatggtgagtcctctgtgttcagtgctgatcaccaaagtggaaatgccttggaatccagggctaaggcacctctctgagagctcccaagagagatcgtgacgcagctaaatcgagcaccggtcgtggtatatactgtctgatggccgcgagggaggcgatacg

SEQ ID NO: 794438 - DNA, 610 bp, Homo sapiens
  misc_feature: 79589.UNK.UNK.UNK.pb.heavy.1.raw 79589
cgtatcgcctccctcgcgccatcagacagtatataccacgaccggtggctcgatttagtgtgagtagtttgggtttggggggaagaggagactgacggtcccactcccaggtacagctggtgcaggtctggggctgaggtgaagaagcctggggcggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatggaccaggagcacctccccaggtacagtctacatggaactgagcagcctgagatctgaggacacggccgtgtatttttctgtgcgaggagccaccagcacctggcttctgacttgtgggggccagggaaccctggtcaccgtctcctcagcctccaccaagggcccatcggtcttccccctggcgccctgctcccaggagcacctccgagagcacagcggccctgggcctgccctggtccaaggactacttcctataactcgtgtctgagcgggctggcaaggcgcatag

SEQ ID NO: 794439 - DNA, 719 bp, Homo sapiens
  misc_feature: 79592.44.56.F01.1.pb.heavy.1.raw 79592
ctatgcgccttgccagcccgctcagacagtatataggaagtagtccttgaccaggcagcccagggccgctgtgcccccagaggtgctcctggagcagggcgccagggggaagaccgatgggcccttggtggaagctgaagagacggtgacccattgtcccctggccccaaatatcaaatgcatcgacgtcccaggatcgcctggcgcagtaatagacgcctgtgtcgtcggtctcaggttgctcatttgtaaatggccaacactgttggagtcatccttgagacggtgaatcttcccttcacagacgcggcgtactctttactttccaccataacgtttcattctgacgaaaagtgatccactcaagccccttccctggagcctgacggacccaggccaagtgataatcactaagactgaatcctgagactacacaggagagtctcagagaccgccctgctggtgccaaagcccccccccgactccgccagtcgcccctcgcactggacaccttctaaaaaaactacaaggaaaatcaagattagcccaaactccatggttggtggtctgtgctcagtgctgatcaccaagtggaaactccttgggaatctcaccggctggggctcctctcccagagctcccctttgtgtgttcagacgtctgctaaatcgagcaccggtcgtgtatatactgtctgatggcgcgagggaggcgatacg

SEQ ID NO: 794440 - DNA, 720 bp, Homo sapiens
  misc_feature: 79595.44.36.D03.1.pb.heavy.1.raw 79595
ctatgcgccttgccaggcccgctcagacagtatattaggaagtagtccttgaccaggcagcccagggccgctgtgctctcggaggtgctcctgagcagggccgccagggggaagaccgatgggcccttggtggaggctgagagacggggtgaccagggttccctggccccagtggacagttcctgatataaacacaaacacaaataatacatgcccgtgtcctcggttttcaggttagtcattcgcagaatcaatgagttcttgaagtcatctcttgagagggtgaatctggctttcacagacgcgggcgtactctgtgataaagctggcaactttgtttttactgcggccaagccactccagcccctttccctggagcctggcggacccccagtccatatagtggtcactgatggtgaatccagaggccgacacaggagagtctcagggaccctccagggctggaccaagtctcccccggactccaccaactgcacttcactctggacaccttgtaaaataacaacaaggaaaacccagctcagcccgaactccatggtgagtcctctgtgttcagtgctgatcaccaaaatgaaaacacctgggaaattctggggctgggggctcgcttctcagagctccccagagagatcgtgacgcagctaaatcgagcaccggtcgtggtatatactgtctgatgggcgcgagggaggcgatacg

SEQ ID NO: 794441 - DNA, 697 bp, Homo sapiens
  misc_feature: 79599.44.55.E11.1.pb.heavy.1.raw 79599
cgtatcgcctccctcgcgccatcagacagtatatacacgaccggtgctcgatttagcactcgcacgttgggtttgggggggagaggagcccagcactggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaagggctggagtgggtctcagtcatttatactggtgattcacatactacgcagactccgtgaaggccgattcaccatctccagggacaattccaggaacacggtttatcttcaatgaacaacctgagaggcgacgacacggccgtctattactgtgcgagacaagtcggcgctcggagtggttattattcgtttgacttctggggccagggaaccctggtcaccgtcgcctccgcctccaccaaggacccatcggtctcccctggcaccctcctccaagagcacctctgggggcacagcggccctggctgcctggtcaaggactacttcctatatactgtctgagcgggctggcaaggcgcatag

SEQ ID NO: 794442 - DNA, 700 bp, Homo sapiens
  misc_feature: 79601.44.36.D03.1.pb.heavy.1.raw 79601
cgtatcgcctccctcgcgccatcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggcccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactgggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggc

SEQ ID NO: 794443 - DNA, 656 bp, Homo sapiens
  misc_feature: 79605.44.86.H09.1.pb.heavy.1.raw 79605
cgtatcgcctccctcgcgccatcagacagtatatacacgaccggtgctcgattttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggggccgtggcaccctggtcactgtctcctcagcttccaccaagggcccgtcggtcttccccctggcgccctgctccaggagcacctctgggggcacagcggccctgggctgcctggtcaaggactacttcctatatactgtctgagcgggctggcaaggcgcatag

SEQ ID NO: 794444 - DNA, 597 bp, Homo sapiens
  misc_feature: 79616.UNK.UNK.UNK.pb.heavy.1.raw 79616
cgtatcgcctcctcgcgccatcagacaggtatatacacgaccggtgctcggattagtgtgaagtagtttgggttggggggaagaggaagactgacgggttccactcccaggtacagctggtgcagtctgggctgaggtgaagaagcctggggcctcagtgacagtctcctgcacggcttctggatacacgttcatcaattatgatattaactgggtgcgacaggccgctggacaagggctggagtggatggggatggatgaagccctatagtggcaacacgggctttgcccagaagttccaaggcagagttagtatgaccaggagcacctccccagggtacagtctacatggaactgaggcagcctgagatctgaggacacggccgtgtatttctgtgcgagagccaccagcacctggcttgacttgttgggccagggaaccctggtcaccgtctcctcagcctccaccaagggcccatcggtcttccccccctggcgccctgctccaggagcacctccgagagcacagcggccctgggctgcctggtcaaggactacttcctatatactgtctgagcgggctggcaagggccatag

SEQ ID NO: 794445 - DNA, 665 bp, Homo sapiens
  misc_feature: 79628.UNK.UNK.UNK.pb.heavy.1.raw 79628
cgtatcgcctccctcgcgccatcagacagtatatacacgaccggtgctccgatttagtacacgtgattagggaaatgggggggctttctgagagtcaaggacctcctgtgcaaagaacatgaagcacctgtggtttttttcctcctgctggtggcagctcccagatgggttcctgtcccaggtgcagctgcaggagtcgggcccaggaactggtgaggccttcgggaaccctgtctctcatctgcactgtcttctggagtttccatcagtttctgatcattcttggaggctggatccggcagcccccagggaggggaatggagtggattggtgacatccaatgatatactggggcgacgtactactctccgtccctcaagagtcgtctcaccatttcgaggacaccgtccatgaaccgcttctccctgaaaactgacctccgtgaccgccgcgggacacgggccgtttatttctgtgcgaggcgagactggtcttcaatctatggggccgtggcaccctggtcacttctcctcagcttccaccaaggcccatcggtcttccccctgggccctgctccaggacacctctggggcacagcggccctgggctgcctggtcaaggactacttcctatatactgtctgagcgggctggcaaggcgcatag

SEQ ID NO: 794446 - DNA, 689 bp, Homo sapiens
  misc_feature: 79631.44.55.E11.1.pb.heavy.1.raw 79631
cgtatcgcctccctcgcgccatcagacagtatatacacgaccggtgctcgatttagcactcgcacgttggtttgggggggagaggagccagcactgggattccgaggtgtttccattcggtgatcagcactgaacacagagactcaccatggagttttggctgagctgggttctccttgtggactttaaaaggtgtccagtgtgaggtgcggctgatggagtctggaggaggcttagtccagcctggggggtccagagactctcctgtgcagcctctggctcaccgtcagcagcaactacatgagttgggtccgccaggctccagggaagggctggagtgggtctcagtcatttatatggtgattcacatactacgcagactccgtgaagggccgattcaccatctccagggacaatccaggaacacggtttatcttcaaatgaacaacctgagaggcgacgacacggccgtctattactgtgcgagacaagtcggcgctcggagtggttattattcgtttgacttctgggccagggaccctggtcaccgtcgcctccgcctccaccaagggccatcggtcttcccctggcaccctcctccaagagcactctgggggcacagcggccctgggctgcctggtcaaggactacttcctatatactgtctgagcggctggcaaggcgcatag

SEQ ID NO: 794447 - DNA, 569 bp, Homo sapiens
  misc_feature: 79635.44.78.H01.1.pb.heavy.1.raw 79635
ctatgcgcctgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctgggaggtgctcctggtcatactaactctgccttggaacttctggcaaagcccgtgttgccactatagggcttcatccatccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 794448 - DNA, 614 bp, Homo sapiens
  misc_feature: 79640.44.23.C01.1.pb.heavy.1.raw 79640
ctatgcgccttgccagcccgctcagacagtatataggaagtagtccttgaccaggcagcccagggccgctgtgccccccagaggtgctcctggagcagggcgccaggggaagaccgatgggcccttggtggaagctgaggagacagtgaccaggtgccacggccccatagattgaaagaccagtctcgcctcgcacagaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttccgaaggcctcaccagtcctgggcccgactcctgcagctgcacctgggacaggacccatctgggagctgccaccagcaggaggaaaaacacagtgttcaccctgcccaatccctatcacgtgtactaaatcgagcaccggtcgtgtatatactgtctgatggcgcgagggaaggcgatacg

SEQ ID NO: 794449 - DNA, 585 bp, Homo sapiens
  misc_feature: 79643.44.78.H01.1.pb.heavy.1.raw 79643
ctatgcgccttgccagccgctcagacagtatataggaagtagtccttgaccaggcagcccagggccgctgtgctctcggaggtgctcctggagcagggcgccaggggaagaccgatgggcccttggtggaggctgaggagacggtgaccagggttccctggcccacaagtcaagccaggtgctggtggctctcgcacagaaatacacggccgtgtcctcagatctcagctgctcagttccatgtagactgtacctggggaaggtgctcctggtcatactaactctgcctttggaacttctgggcaaagcccgtgttgccactatagggcttcatccatcccatccactcagccttgtccagcggcctgtcgcacccagttaatatcataattgatgaacgtgtatccagaagccgtgcaggagactgtcactgaggccccaggcttcttcacctcagccccagactgcaaccagctgtacctggagtgggaccgtcagtcttctccttcccccaaacccaaactactcacactaaatcgagcaccggtcgtgatatactgtctgatggcgcgaggaggcgatacg

SEQ ID NO: 794450 - DNA, 725 bp, Homo sapiens
  misc_feature: 79659.44.85.H08.1.pb.heavy.1.raw 79659
ctatgcgccttgccagcccgctcagacagtattataggaagtagtccttgaccaggcagcccagggcgctgtgcgcagaggtgctcttggaggagggttgcccaaggggaagacgatggccttggtgaggctgagagacggtaccgtggtcctttgcgcagacgttccataccgttagtagttagttcccagcaggggtagtactacaatatgtcctcgcacagtaatacacagccggtggtcctcggctctcaggctgttcatttgcagatacagcgtgttcttggaattgtctctggagattggtgaatcggccttcacggagtctgcatagtatttattacttccatcataccatataagtgcacccactccagcccttgcctggagctgggcggaccagtgcatgccataggtactgaaggtgaatccagaacgctgcaccaggagagtctcagggacctcccaggctggacacgcgctccccagactcaccagcctgcacctgacactgccgacaccttcttaaagagcaaccgagaaaacccagctcagccaaaacttccatggtgagtcctctgtgttcagtgctgatcaccgaatggaaacaccgccgaggcttctagtgctgggcctcctcttcccagagctcccgcgactgagtgatactaaatcgagcaccggtcgtgtatatactgtctgatggcgccgagggaggcgatacg

SEQ ID NO: 794451 - DNA, 682 bp, Homo sapiens
  misc_feature: 79670.UNK.UNK.UNK.pb.heavy.1.raw 79670
ctatgcgccttgccagcccgctcagacagtatataggaagtagtccttgaccaggcagcccagggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccgtcgtgtatataactgtctgatggcgcgagggagggcgatacg

SEQ ID NO: 794452 - DNA, 732 bp, Homo sapiens
  misc_feature: 79672.44.33.C11.1.pb.heavy.1.raw 79672
ctatgcgccttgccagcccgctcagacagtatataggaagtagtccttgaccaggcagcccaggggccgctgtgcccccagaggtgctcttggaggagggtgccagggggaagaccgatgggccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggccctttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaaaacccaacgagctcactctaaatcgagcaccggtcgtgtatatactgtctgatggcgcgagggaggcgatacg

SEQ ID NO: 794453 - DNA, 720 bp, Homo sapiens
  misc_feature: 79674.UNK.UNK.UNK.pb.heavy.1.raw 79674
ctatgcgccttgccagccgctcagacagtatataggagtagtccttgaccaggccagccagggccgctgtgccccagaaggtgctctttgggaggagggtgccaggggaaagaccgattgggcccttggtgggagggcggagcgacggtgaccagggttccctggccccagaagtcaaaccgaataataaaccactccgagcgccgacttgtcctcgcacagtaatagacggccgtgtcgtcgcctctcaggttgttcatttgaagataaaccgtgttcctggaattgtccctggagatggtgaattcgcccttcacggagtctgcgtagtatgtgaaatcaccagtataaatgactgagaccccactccagccccttccctggagcctggcggaccccaactcatgtattgctgctgacggtgagcccagaggctgcacaggagagtctctgggaccccccaggctggactaagcctcctccagactccatcagccgcacctcacactggacacctttttaaaagtccaacaaggagaaccccagctcagccaaaacctccatggtgagtcctctgtgttcagtgctgatcaccgaatggaaacactcggaatcccagtgctgggctcctctccccccccaaacccaaacgtgcgagtgctaaatcgagcaccgggtcgtggtaatatactgtctgatgggcgccgaggaggcgatacg

SEQ ID NO: 794454 - DNA, 649 bp, Homo sapiens
  misc_feature: 79676.44.86.H09.1.pb.heavy.1.raw 79676
ctatgcgccttgccagcccgctcagacagtatataggaagtagtccttgaccaggcagcccagggccgctgtgccccagaggtgctcctggagcagggcgccaggggaagaccgatgggcccttggtggaagctgaggagacagtgaccagggtgccacggcccccatagattgaaagaccagtctcgcctcgcacagaaataaacggcgtgtccgcggcggtcacggaggtcagtttcagggagaagcggttcatggacgtgtcctcgaaatggtgagacgactcttgaggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcacctgggacaggaccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 794455 - DNA, 728 bp, Homo sapiens
  misc_feature: 79679.UNK.UNK.UNK.pb.heavy.1.raw 79679
cgatcgcctccctcgcgccatcagacagtatatacacgaccggtgcctcgatttagtgctatagacttgggtggggagctctgggagaggagcccagcaccagaagtcggcggtgtttccagtcggtgatcagcaccgaacacagaggactcaccatggagtttggggctgacctggttttcctcgttgctcttttaagaggtgtccagtgtcaggtgaagctggtggagtctgggggaggcgtggtccagcctgggaggtccctgagactctcctgtgtagcgtctggattcaccttcacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794456 - DNA, 637 bp, Homo sapiens
  misc_feature: 79681.44.86.H09.1.pb.heavy.1.raw 79681
cgtatcgcctccctccgcgcatcagacagtatatacacgaccggtgctcgatttagtgctatagacttgggtttggggatgctttctgagagtcaaggacctcctgtgcaagacatgaagcacctgtggtttttcctctgctgggtggcagctccagatgggtcctgtcccaggtgcagctgcaggagtcgggcccaggactggtgaggccttcgggaaccctttctcatctgcactgtctctggagtttccatcagttctgatcattcttgggctggatccgcggagccccaggagggggaatggagtggattggtgacatccattatactggggcgacgtactacttccgtccctcaggtcgtctcaccatttcgaggacacgtcatgaacgcttctcctgaaactgacctccgtgaccgcgcggacacggccgtttatttctgtgcgaggcgggactggtctttcaatctatggggccgtggcaccctggtcactgtctcctcagcttccacaagggcccatcggtcttccccctggcgcctgctccaggagcacctctggggcacagcggccctggctgcctggtcaaggactacttcctatatactgtctgagcgggctgcaaggcgcatag

SEQ ID NO: 794457 - DNA, 615 bp, Homo sapiens
  misc_feature: 79686.UNK.UNK.UNK.pb.heavy.1.raw 79686
cgtatcgcctccctcgcgccatcagacagtatatacactaccggtgctcgatttagtacacgtgattagggattggggcagggtgaacacctgtggtttttcctcctgctggtggcagctcccagatgggtcctgtccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatactggggcgacgtactactctccgtcctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgccctgctccaggagcactctgggggcacagcggccctgggctgcctggtcaaggactacttcctatatactgtctgagcgggctggcaaggcgcatag

SEQ ID NO: 794458 - DNA, 611 bp, Homo sapiens
  misc_feature: 79699.UNK.UNK.UNK.pb.heavy.1.raw 79699
gaaggctgggcaggctatgcaccctggtccaggtcaaaagctgcggaacccgctagcggccatcttggccactaggggtccccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagttaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagacccgcatctggcgcctaaacgttcagtggtagctaaggcgtcaccttcgactgtctaaaggcaatatgtcgtccttagctccaagtccctagcaagcgtgtcggg

SEQ ID NO: 794459 - DNA, 704 bp, Homo sapiens
  misc_feature: 79723.44.36.D03.1.pb.heavy.1.raw 79723
cgtatcgcctcctcgcgccatcagacagtatatacacgaccggtgctcgattagctgcgtcacgatctctcttgggagctctcagagaggtgccttagccctggattccaaggcatttccacttggtgatcagcactgaacacagaggactcaccatggagttgggctgcgctggttttccttgttgctattttagaagcgtgtccactgtgaggtgcggctgtgagtctgggggaggcttggtacagcggggggggtccctgagactctcctgtgcagcctctggattcatcttcagtgactaatgccatgaactgggtccgccaggctccagggaaggggctggagtgggtttcatatgttaatattgctggagataccacctactacgcagactctgtgaagggccgattcaccattccagggacaatgccaagaactcactgtatctggaaatgaacagcctgagagacgaggacacggctgtctacttctgttcgagagatcgggccacttggtcagtgctggtttgactactggggccggggaaccctggtcaccgtctcctcagcctccaccaaggcccatcggtcttcccccctggcgccctgctcaggagcacctccgagagcacagcgccctgggcctgcctggtcaaggactacttcctatatactgtctgagcgggctggcaaggcgcatag

SEQ ID NO: 794460 - DNA, 625 bp, Homo sapiens
  misc_feature: 79744.44.23.C01.1.pb.heavy.1.raw 79744
ctatgcgccttgccagcccgctcagacagtatataggaagtagtccttgaccaggcagcccaggccgctgtttgcccccagaggtgctcctggagcagggcgccagggggaagaccgatgggcccttggtggaagctgaggagacagtgaccagggtgccacggccccatagattgaaagaccagtcctcgcctcgcacagaaataaacggccgtgtccgcggcggtcacggaggtcagtttcagggagaagcggttcatggacgtgtccctcgaaatggtgagacgactcttgaggacggagagtagtacgtcgccccagtataatggatgtcaccaatccactccattcccctccctgggggcttgccggatccagccccagaatgatcagaaactgaatggaaactccagagacagtgcagatgagagacagggttcccgaagggctcaccagtcctgggcccgactcctgcagctgcacctgggacaggacccatctgggagctgccaccagcaggaggaaaaaccacagggtgttcaccctgccccaatccctaatcacgtgtactaaatcgagcaccggtcgtgtatatactgtctgatggcgcgagggaggcgatacg

SEQ ID NO: 794461 - DNA, 738 bp, Homo sapiens
  misc_feature: 79759.44.33.C11.1.pb.heavy.1.raw 79759
ctatgcgcccttgccagcccgctcagacagtatataggaagtagtccttgaccaggcagcccagggccgctgtgccccagaggtgctcttggaggagggtgccagggggaagaccgattgggcccttggtggaggctgaggagacggcgaccgtggtcccttggccccaggcgtccataccattggagtagagcatgtcatatctgtatccacgagccccatcttctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtcttcagggacctcccaggctggaccacgctcccccagactccaccagcttcacctgacactggacacctcttaaaagagcaacgagggaaaaacccaggtcagcccaaactccatggtgagtcctctgtgtttcggtgctgatcacaccgactgaaacaccgccgacttctggtgctgggctcctctcccagagctccccaaaaccaacgagctcactctaaatcgagcaccggtcgtgtatatatactgtctgatggcgcgagggaggcgatacg

SEQ ID NO: 794462 - DNA, 699 bp, Homo sapiens
  misc_feature: 79768.UNK.UNK.UNK.pb.heavy.1.raw 79768
cgtatcgcctccctcgcgccatcagacagtatatacacgacggtgctcgatttagagagagtgtgttgagctctggggagaggaagccccagcctttggattcccaggtgttttcattcagtgatcaggactgaacacagaggactcaccatggagttttttgggctgagctggattttccttgctgctattttaaaaaaggtgtccagtgtgaggtgcagtttggtggagtcgtgggggaggtttggtaagaagcctggggagtccctttagactctcctgtgcagctctggattcactttcagtaacgcctggatgacctgggtccgccagggctccagggaaggggctggagtgggttggccgtattagaaccaaagctgacggtgggacagcagactacgctgcaccacgtgaaaggcaagatttcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatccggtcttccccctggcgcccctgctccaggagcacctccgagagcacagcggccctgggctgcctggtcaaggactacttcctatatactgtctgagcgggctggcaaggcgcatag

SEQ ID NO: 794463 - DNA, 724 bp, Homo sapiens
  misc_feature: 79776.44.33.C11.1.pb.heavy.1.raw 79776
ctatgcgcctgccagcccgctcgacagtatataggaagtagtccttgaccaggcagccagggccgctgtgccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcgctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaactccatggtgagtcctctgtgttcggtgctgatcaccgactggaaacaccgccgacttctggtgctgggctcctctcccagagctcccaaaacccaacgagctcactctaaatcgagcaccggtcgtgtatatactgtctgatggcgcgagggaggcgatacg

SEQ ID NO: 794464 - DNA, 706 bp, Homo sapiens
  misc_feature: 79787.44.36.D03.1.pb.heavy.1.raw 79787
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgccgagggaggcgatacg

SEQ ID NO: 794465 - DNA, 698 bp, Homo sapiens
  misc_feature: 79810.44.27.C05.1.pb.heavy.1.raw 79810
cgtatcgcctcctcgcgcatcagacagtatatacacgaccggtgctcgattagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggcccagtagggggtccctgagactctcctgtgcagcctctggattcaccttcgataattggaatatgcagtggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgttccaaaatcggttcattcgacgcctgggccagggaaccctggtcaccgtctcctcggcctccaccaagggccatcggtcttccccctggcgccctgctccaggagcacctccgagagcacagcggccctgggctgcctggtcaaggactacttcctatatactgtctgagcgggctggcaaggcgcatag

SEQ ID NO: 794466 - DNA, 652 bp, Homo sapiens
  misc_feature: 79811.44.86.H09.1.pb.heavy.1.raw 79811
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaccacaggtgcttcatgttcttgcacaggaggtccttgactctcagaaagcatccccaaacccaagtctatagcactaaatcgagcaccggtcgtgtatatactgtctgatggcgcgagggaggcgatacg

SEQ ID NO: 794467 - DNA, 705 bp, Homo sapiens
  misc_feature: 79821.UNK.UNK.UNK.pb.heavy.1.raw 79821
cgtatcgcctccctcgcgccatcagacagtatatacacgaccgggtgctcgatttagcactcgcacgttgggttgggggggagaggagcccagcactgggattccgaggttgttccattcggtgatcagcactgaacacagaggactcaccatgagttttggctgagctgggttctccttgttggacttttaaaaggtgtccagtgtgaggtgcggctgatgagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacaccggtttatcttcaaatgaacaacctgagaggcgacgacacggccgtctattactgtgcgagacaagtcggcgctcggagtggttattattcgtttgacttctgggccagggaaccctggtcaccgtcgccctccgcctccaccaagggcccatcggtcttccccctggcaccctcctccaagagcaccttggggccacagcggccctgggcctgcctggtcaaggactactcctatatactgtctgagcggggctggcaaggcgcatag

SEQ ID NO: 794468 - DNA, 682 bp, Homo sapiens
  misc_feature: 79829.44.27.C05.1.pb.heavy.1.raw 79829
cgtatcgcctccctcgcgccatcagacagtatatacacgaccggtgctcgatttagacgcgatcgaagggtttggggggaagaggaagtcgccggtgtttccactcgtgatcatcactgaacacagaggactcaccatggagtttgggctgagctgggttttcctcgttgccctcttaagagtgtcatgtgtcaggtgcaattcgtggagtctggggaggcgtggccccagtagggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggcgattcaccatctccagagacaattccgagaacacagtgtctcttcaaatgaacagcctgagacctcaggacacggccgtgtatttttgtgcgagactatctgtttcaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794469 - DNA, 692 bp, Homo sapiens
  misc_feature: 79834.44.74.G08.1.pb.heavy.1.raw 79834
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggtgacaatgaccagggttccctgcccccagatctcaaaggctccatgcgagctggggtacggacctctcgcacagtagtagacggccgtgtcgtcggatttcaaagaactcattgtcatggagactgtgtctgtggacttgtccgcggtaatcgtaaattctgccccggaagtctcgtgcgtaggtgagtgagccaaaagagggatgattccacccatccactcaagccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaaatcgagcaccggtcgtgtatatactgtctgatggcgcgagggaggcgatacg

SEQ ID NO: 794470 - DNA, 684 bp, Homo sapiens
  misc_feature: 79835.44.45.E01.1.pb.heavy.1.raw 79835
ctatgcgccttgccagcccgctcagacagtatataggaagtagtccttgaccaggcagcccagggccgctgtgctctcggaggtgctcctggagcagggcgccagggggaagaccgatgggcccttggtgggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794471 - DNA, 607 bp, Homo sapiens
  misc_feature: 79852.UNK.UNK.UNK.pb.heavy.1.raw 79852
ccgacacgcttgctagggacttggagctaaggacgacatattgcctttagacagtcgaaggtgacgccttagcctaccactgaacgtttaggcgccagatgcggtcctgggatgaccctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcaccccccacatagcctgcttggggtgttgagtttacttttatttcgtgttggaatgagttgaacttccggaagtggagtaatgggtttgtctacttcccctaaccgcaaagtactagttttaccgagtgcgttgcaagccatagccagtcacaggtaataaacaattcaacgtggcgtaaagattggccgcttgctgtggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794472 - DNA, 753 bp, Homo sapiens
  misc_feature: 79855.UNK.UNK.UNK.pb.heavy.1.raw 79855
cgtatcggcctccctcgcgcgccatcagacagtatatacggacgaccggtgctgcgatttagcagaccgtctgaacacacaaaggggagctcggagagcggaacgccccgagccgtgagattcccaggagttccactggtgatcagcactgagcacagaccaccaaccatggagtttgggcatctaatcttgttattttccttgtgattttgtttacgaagtgttacgcagtgcgaggcgctgggggcaagtcgggggcctggcagcagccgcggtggccgagctctctgagacgtctccgtgtagtctcaggaattcgagtcttagtgatatcaacttggcctgggtccgttcagctccagggaaaggggctcttgacgtggatcactttcgtcagatgaaacgtatgggtggaagtaagagtacgccgcgtctgtgaagggaagattcaccgtctcaagggatgactcccaacagtgttggcccatttacaatgagcaacctgagacccgacgacacaggcgtctattactgcgcgccaggcgaatcctggacgtcgatggcatttgatatttggggccagggacaatggtcaccgtctcttcagcttccaccaagggcccatcggtcttccccctggcgccccctgctccaggagcacctctgggggcacacagcggccctgggctgcctggtcaagcgtactacttcctacattatactgtctgagcgggctggcaaggcgtcgcatag

SEQ ID NO: 794473 - DNA, 609 bp, Homo sapiens
  misc_feature: 79860.UNK.UNK.UNK.pb.heavy.1.raw 79860
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcggggacccctagtggccaagatggccgctagcgggttccgcagcttttgacctggaccagggtgcatagcctgcccagccttc

SEQ ID NO: 794474 - DNA, 699 bp, Homo sapiens
  misc_feature: 79862.UNK.UNK.UNK.pb.heavy.1.raw 79862
tatgcgccttgccagcccgctcagacagtatataggaagtagtccttgaccaggcagcccaggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgctctcaggttgttcattttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccccaacccaacgtgcgagtgctaaatcggcaccggtcgtgtatatactgtctgatggcgcgaggaggcgatacg

SEQ ID NO: 794475 - DNA, 637 bp, Homo sapiens
  misc_feature: 79867.UNK.UNK.UNK.pb.heavy.1.raw 79867
ctatgcgccttgccagccgctcagacagtatataggaagtagtccttgaccaggcagccagggccgctgtgcccccagaggtgctctggagcaggcgccaggggaagaccgatgggcccttggtggaagctgaggagacagtgaccagggtgcacggcccatagattgaaagaccagtctcgcctcgcacagaaataaacggccgtgtccgcggcggtcacggaggtcagtttcagggagaaagcggttcatgacgtgtcctcgaaatggtgagacgactcttgagggacggagagtagtacgtcgcccagtataatggatgtcaccaatcactccattcccctccctggggctgcggatccagcccaagaatgatcagaactgatggaaactccagagacagtgcagatgagagacagggttcccgaaggcctcaccagtcctgggcccgactcctgcagctgcacctggacagacccatctgggagctgccaccagcaggaggaaaaaccacaggtgcttcatgttcttgcacaggaggtccttgactctcagaaagcatcccaaacccaagtctatagcactaatcgagcaccgtcgtgtatatactgtctgatggcgcgagggaggcgatacg

SEQ ID NO: 794476 - DNA, 724 bp, Homo sapiens
  misc_feature: 79869.44.86.H09.1.pb.heavy.1.raw 79869
cgtatcgcctccctcgcgcatcagacagtatatacacgaccggtgctcgatttagtgctatagacttgggttggggagctctgggagaggagccagcaccagaagtcggcggtgtttccagtcggtgatcagcaccgaacacagaggactcaccatggagtttggctgacctgggttttcctcgttgctcttttaagaggtgtccagtgtcaggtgaagctggtggagtctgggggaggcgtggtccagcctgggaggtccctgagactctcctgtgtaagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatgtatggacgcctggggccaagggaccacggtcgccgtctcctcagcctccaccaaggcccatcggtcttcccctggcaccctcctccaagagcacctctgggggcacagcggccctgggctgcctggtcaaggactacttcctatatactgtctgagcgggctggcaaggcgcatag

SEQ ID NO: 794477 - DNA, 652 bp, Homo sapiens
  misc_feature: 79893.44.23.C01.1.pb.heavy.1.raw 79893
cgtatcgcctccctcgcgccatcagacagtatatacacgaccggtgctcgatttagtacacgtgattagggattgggggctttctgagagtcaaggaccctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgccactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccagggcccatcggtcttcccctggcgccctgctccaggagcacctctgggggcacagcggccctgggctgcctggtcaaggactacttcctatatactgtctgagcgggctggcaaggcgcatag

SEQ ID NO: 794478 - DNA, 452 bp, Homo sapiens
  misc_feature: 79903.UNK.UNK.UNK.pb.heavy.1.raw 79903
ctatgcgccttgccagcccgctcagacagtatataggaagtagtccttgaccaggcagcccagggccgctgtgcccccagaggtgctcctggagcagggcgccagggggagaccgatgggcccttggtggaagctgaggagacagtgaccaggtgccacggccccatagattgaaagaccagtctcgcctcgcacagaaataaacggcgtgtccgcggcggtcacggaggtcagtttcagggagaagcggttcatggacgtgtccctcgaaatggtgagacgactctttgaggacggagagtagtacgtcgcccccagtataatggatgtcaccaatccactccattcccctccctgggggctgccggatccagcccaagagagatcgtgacgcagctaaaatcgagcaccgtcgtgtatatactgtctgatggcgcgagggaggcgatacg

SEQ ID NO: 794479 - DNA, 654 bp, Homo sapiens
  misc_feature: 79921.UNK.UNK.UNK.pb.heavy.1.raw 79921
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatcccaatcccaagtcacgtgcactaaatcgagcaccggtcgtgtatatactgtctgatggcgcgagggaggcgatacg

SEQ ID NO: 794480 - DNA, 578 bp, Homo sapiens
  misc_feature: 79943.44.78.H01.1.pb.heavy.1.raw 79943
cgtatcgcctccctcgcgccatcagacagtatatacacgaccggtgctcgatttagtgtgagtagttttgggtttgggtgccgaaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggattgggatggatgaagccctatagtggcaacacgggcttttgcccagaagttccaaggcagagttagtatgaccaggagcaccctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794481 - DNA, 665 bp, Homo sapiens
  misc_feature: 79957.44.12.B01.1.pb.heavy.1.raw 79957
cgtatcgcctccctcgcgccatcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgcgccgcgacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794482 - DNA, 711 bp, Homo sapiens
  misc_feature: 79999.UNK.UNK.UNK.pb.heavy.1.raw 79999
agacccaggttatataggaagtagtccttgaccaggcagcccaggggccgctggtgctctcggaggtgctcctggagcaggagggcgccagggggaagaccgatgggcccttggtggggccgaggagacggtgaccagggttcccctggcccaggcgtcgaatgaaaccgattttggaaacaggatagtcctcgcacaaaaatacacggccggtgtcctgaggtctcaggctgttcatttgaagagacactgtgttctcggaattgctctctggagatggtgaatcggccctcaacggaatcacccgtagacttgatttcctcccatgaaatgacacacctgccacccactccagccctcgcctggagcctggcggacccactgcatattccaattatcgaaggtgaatccagagggctgcacagggagagtctcagggacccccctactggggccacggcctcccccagactccaccgaattgcacctgacacatgacacctcttaagagggcaacgaggaaaacccagctcagcccccaaactccatggtggagtccctctgtgttcagtgatgatcacccgagtggaaacaccgggcgacttccagtgcctgggctcgtctcccaggccccaaacccttcgaatcgcgtctaaatcgagcaccggtccgtgtatatactgtctgatggcggcgagggcaggcgatacg

SEQ ID NO: 794483 - DNA, 709 bp, Homo sapiens
  misc_feature: 80004.44.70.G04.1.pb.heavy.1.raw 80004
cgtatcgcctccctcgcgccatcagacagtatatacacgaccggtgctcgatttagtgtagtgtgaagggaaaggggtctgggagaggagcccagcactagaaagtcggcggtgtttccattcggtgatcagcactgaacacagaggactcaccatggagtttgggctgagctgggttttcctcgttgctcttttaagaggtgtcactgtcaggtgcacctggtggagtctgggggaggcgtgtccagcctgggaggtccctgagactctcctgtgaagcctctggatttagtttcagtggttctggcatgcactgggtccgccaggctccaggcaaggggccggagtggttggcagttatagcacatgatggaagttctgatattatgcagactccgtgaagggccgattcaccatctccagagacaattccccggaaacattgtgtacttggaaatggtcagcctgagagtcgaggactcggctctgtattactgtgcgagatcgggaggtggtagtagtttattaccggcgcatgactggggccaggggaccctggtcaccgtctcctcagcctccaccaagggcccatcggtcttccccctggcgccctgctccaggagcacctccgaggagcacagcggccctggctgccctggtcaaggactacttcctatatactgtctgagcgggctggcaaggcgcatag

SEQ ID NO: 794484 - DNA, 646 bp, Homo sapiens
  misc_feature: 80014.44.53.E09.1.pb.heavy.1.raw 80014
ctatccgccttgccagcccgctcagacagtatataggaagtagtcctgaccaggcagccagggcccgctgtgctctcggaggtgctcctgggcagggcgccagggggtaagacgatgggcccctggtggagctgcgaggatgaggagacggtgaccgtggtccttggccccagacgtcccaagcgtagtagattgagacgacctgccataggcgggacccatgtctgacacagtagtagacagccggtgtcggcgggcggccacagaactcactttcaggaaaactgtgtcctcgacgtgtccacggatatggtgactcgaccgttgaggacggttgtagtaggtgttccactataatagagactcccatccactgcagccgctctcctggggggctggcgggatccagcccagtagaaattacttctgtcgatggaggcaccagagaccgtgcacgtgaggacaggtctcgaaggcttcaccagtcctgggccgactcccgcagcgcggctgagacaggacccatctggagcccgccaccagcaggaggaagaaccacaggtgcttcccccaacccaacacactctctctaaatcgagcaccggtcgtgtatatactgtctgatggcgccgagggaggcgatacg

SEQ ID NO: 794485 - DNA, 674 bp, Homo sapiens
  misc_feature: 80018.UNK.UNK.UNK.pb.heavy.1.raw 80018
ctatgcgccttgccagcccgctcagacagtatataggaatgtagtcttgaccaggcagcccagggccgctgctctcgaggtgctctggagcagggcgccagggggagaccgatggcccttggtggaggctgaggagacggtgaccagggttccctggccccagtggacagttcctgatataaacacaaacacataatacatgcccgtgtcctcggttttcaggttagtcattcgcagaatcaatgagtttcttgaagtcatctcttgagagggtgaatctggcttcacagacgcgcgtactctgtgataagctggcaactttgtttttactgcgccaagccactccagccccttccctggagcctggcggacccagtccatatagtggtcactgatgtgaatcagaggcgacacaggagagtctcagggcccctccaggctggaccaagtctccccggactccaccaactgcacttcactctggacaccttgtaaataacaacaaggaaaacccagctcagccgaactccatggtgagttctctgtgtttcagtgctgatcacaatgaaaacacctgggaatctgggctggggctcgctctccccagaggatcgtgacgcagctaaatcgagcccggtgtgtatatactgtctgatggcgcgaggagcgatacg

SEQ ID NO: 794486 - DNA, 706 bp, Homo sapiens
  misc_feature: 80025.44.55.E11.1.pb.heavy.1.raw 80025
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccccccaaacccaacgtgcgagtgctaaatcgagcaccggtcgtgtatatactgtctgatggcgcgagggaggcgatacg

SEQ ID NO: 794487 - DNA, 653 bp, Homo sapiens
  misc_feature: 80035.44.23.C01.1.pb.heavy.1.raw 80035
ctatgcgcctgccagcccgctcagagacagtatataggaagtagtccttgaccaggcagcccagggccgctgtgcccccagaggtgctcctggagcagggcgcccagggggaagaccgatgggcccttggtggcaagctgaggagacagtgaccagggtgccacgggcccatagattgaaaagaccagtctcgcctcgcacagaataacggccgtgtccgcggcggtcacggaggtcagtttcagggagaagcggttcatggacgtgtccctcgaaatggtgagacgactcttgagggacgagagtagtacgtcgcccagtataatggatgtcaccatccactccattcccctccctggggctgccggatccagccccaagaatgatcagaactgatggaaactccagagacagtgcagatgagagacagggttcccgaaggcctcaccagtcctgggcccgactcctgcagctgcacctggacaggacccatctgggagctgccaccagcaggaggaaaaaaccacagggggcttcatgttcttgcacaggaggtccttgactctcagaaagccccaatccctaatcacgtgtactaaatcgagcaccggtcgtgtatatactgttctgatggcgcgagggaggccgatacg

SEQ ID NO: 794488 - DNA, 702 bp, Homo sapiens
  misc_feature: 80051.44.55.E11.1.pb.heavy.1.raw 80051
ctatgcgccttgccagcccgctcagacagtatataggaagtagtccttgaccaggcagcccagggccgctgtgcccccagaggtgctcttggaggagggtgccagggggaagaccgatgggcccttggtggggcggaggcgacggtgaccagggttccctggccccagaagtcaaacgaataataaccactccgagcgccgacttgtctcgcacagtaatagacggccgtgtcgtcgcctctcaggttgttcatttgaagataaaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagcccagaggctgcacaggagagtctctgggacccccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctcccaaacccaacgtgcgagtgctaaatcgagcaccggtcgtgtatatactgtctgatggcgcgagggaggcgatac

SEQ ID NO: 794489 - DNA, 691 bp, Homo sapiens
  misc_feature: 80072.44.36.D03.1.pb.heavy.1.raw 80072
cgtatcgcctccctcgcgccatcagacagtatatacacgaccggtgctcgatttagctgcgtcacgatctctcttgggagctctgagagcggagccccagcccagaattcccaggtgttttcatttggtgatcagcactgaacacagaggactcaccatggagttcggctgagctgggttttccttgttgttattttacaaggtgtccagagtgaagtgcagttggtggagtcggggagacttggtccagcctggagggtccctgagactctcctgtgtcgcctctggattcaccatcagtgaccactatatggactgggtccgccaggctccagggaagggctgagtggcttggccgcagtaaaaacaaagttgccagctttatcacagagtacgccgcgtctgtgaaagccagattcaccctctcaagagagacttcaagaactcattgattctgcgaatgactaacctgaaaaccgaggacacggggcatgtattattgtgttgtgtttatatcaggaactgtccactggggccagggaaccctggtcaccgtctcctcagcctcccaccaagggcccatcggtcttcccctgcgccctgccaggcacctccggagcaacagcggccctgggctgcctggtcaaggacacttcctatatactgtctgagcgggctgcaaggcgcatag

SEQ ID NO: 794490 - DNA, 621 bp, Homo sapiens
  misc_feature: 80087.44.23.C01.1.pb.heavy.1.raw 80087
cgtatcgcctccctcgcgccatcagacagtatatacacgaccggtgctcgatttagtacacgtgattagggattgggcagggtgaacacctgtggtttttcctcctgctggtggcagctcccagatgggtcctgtcccaggtgcagctgcaggagtcgggcccaggactggtgaggccttcgggaaaccctgtctctcatctgcactgtctctggagtttccatcagttctgatcattcttggggctggatccggcagcccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggccccatcggtcttccccctggcgccctgctccaggagcacctctgggggcacagcggccctgggctgcctggtcaaggactacttcctatatactgtctgagcgggctggcaaggcgcatag

SEQ ID NO: 794491 - DNA, 617 bp, Homo sapiens
  misc_feature: 80088.44.23.C01.1.pb.heavy.1.raw 80088
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttccccctggcgcccctgctccaggagcacctctgggggcacagcggccctgggctgcctggtcaaggactacttcctatatactgtctgagcgggctggcaaggcgc

SEQ ID NO: 794492 - DNA, 679 bp, Homo sapiens
  misc_feature: 80092.44.53.E09.1.pb.heavy.1.raw 80092
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaactacttcctatatactgtctgagcggctggcaaggcgcatag

SEQ ID NO: 794493 - DNA, 704 bp, Homo sapiens
  misc_feature: 80096.44.56.F01.1.pb.heavy.1.raw 80096
gccttgccagcccgctcagacagtatataggaagtagtccttgaccaggcagcccagggccgctgtgccccagaggtgctcctggagcaggcgccagggggaagaccgatgggcccttggtggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccccgactccgccagtcgcccctcgcactggacaccttctaaaaaaactacaaggaaaatcaagattagcccaaactccatggttggtggtctgtgctcagtgctgatcaccaagtggaaaactcctgggaatctcacggctggggctcctctcccagcccctttgtgtgttcagacgtctgctaaatcgagcaccggtcgtgtatatactgtctgatggcgcgagggaggcgatacg

SEQ ID NO: 794494 - DNA, 681 bp, Homo sapiens
  misc_feature: 80098.UNK.UNK.UNK.pb.heavy.1.raw 80098
cgtatcgcctccctcgcgccatcagacagtatatacacgacggtgctcgattagcactcgcacgttgggtttgggggaagaggagcccagcactgggattccgaggtgttccattcggtgatcagcactgaaccagaggaactcacaatggagttttgctgagctgggttctcttgttggacttttaaaaggtgtccagtgtgaggtgcggctgatggagtctggaggagcttagtcagcctggggggtcccagagactctcctgtgcagcctctgggctcaccgtcagcagcaactacatgagttgggtcgccaggctccagggaaggggctggagtgggtctcagtcatttatacggtgatttccatactacgcagactcgtgaaggccgattcacatctcagggacaattcaggaacacggtttatcttcaatgacaacctgagaggcgcgacgaccggcgtctattactgtgcgagacaagtcggcgtcggagtgttattattcgtttgacttctgggccaggaacccggtcaccgtcgcctccgcctcacccaagggcccatcggtcttcccctggcaccctcctccagagcacctctgggggcacagcggccctgggctgcctggtcaaggactacttcctatatactgtctgagcgggctggcaaggcgcatag

SEQ ID NO: 794495 - DNA, 654 bp, Homo sapiens
  misc_feature: 80113.44.86.H09.1.pb.heavy.1.raw 80113
cgtatcgcctcctcgcgccatcagacagtataatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794496 - DNA, 694 bp, Homo sapiens
  misc_feature: 80121.44.9.A09.1.pb.heavy.1.raw 80121
ctatgcgccttgccagccgctcagacagtatataggaaagtagtccttgaccaggcagcccagggccgcctgtgctctcggaggtgctcctggagcagggcgccagggggaagaccgatggcgcccttggttggagggccctggaggagagacggtgaccagggttccctggccccagtagtcaagcggggaccgtctcgagggccctcgcacaataatgacagcccgtgtcctcacttgtgaggttgtacatttgcagatgcacgtgtgtcctgaattgtctctggagacggtggaatcggcccttctcggagtctccgtagtgttcttcaattccatcttctgatataattgccaaccacccagcccttgcctggagcctggcggacccagtgcatggcaatagtcctgaagatgaatccagaggctgcacaggagagtctcagggagttcccaggctgggccgctcctcccccagactcactagctgcacctgacactggccacctcttaaaagagcaacgaggaaaacccatctcagcccaaagtccatggtggtcctctgtgttcagtgatgatcaccgaatggaaacaccgcgacttccagtgctgggcctcgtctccccccctgcgcgtctcgctaatcgagcaccggtcgtgtatatactgtctgatggcgcgaggaggcgatacg

SEQ ID NO: 794497 - DNA, 682 bp, Homo sapiens
  misc_feature: 80126.UNK.UNK.UNK.pb.heavy.1.raw 80126
cttgcgccttgccagcccgctcagacagtatataggaaagtagtccttgaccaggcagcccagggccgctgtgctctcggaggtgctcctggagcagggcggccaggggggaagaccgatgggcccttggtggaggctgatgggagacggtgacctggatttccctggccccagggttcgaagaaagcccgtggtcattgtggtcatgaagtgggcacagaaatatgtgccctgtggtccacagggtccacgttggtcaatgtaaggacccaccttggtttttttggaccgtgtccttcgtgagcgtgaggtctggtcgtcagaagaaaggactatatcgtatattcgtcattcccaataagtgagtgcgattccaccccagggcctttccggggggctgccgcacccagacaaacgccctctccaggagtgacgagtgagaagcctgagacggtggcaggtcagcgtgagggtctgtgtgggtttccaccaatgtagggccagactctttttcacggtgatctggggacaggccccatgaaagggatggtcagcagcaggagcgtggagccaaagtgtgtccaatggtggggcacaggagtccccccttactgactcactaaaatcgagcacccggtcgtgtatatactggttctgaatggcgcgaggggagggcgatacg

SEQ ID NO: 794498 - DNA, 686 bp, Homo sapiens
  misc_feature: 80129.44.27.C05.1.pb.heavy.1.raw 80129
ctcagacagtatataggaagtagtccttgaccaggcagcccagggccgctgtgctctcggaggtgctcctggagcagggcgccagggggaagaccgatgggcccttggtggaggccgaggagacggtgaccagggttcccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaaccagctcagcccaaactccatggtgagtcctctgtgttcagtgatgatcaccgagtggaaacaccggcgacttccagtgctgggctcgtctcccaggcccccaaacccttcgatcgcgtctaaatcgagcaccggtcgtgtatatactgtctgatggcgcgagggaggcgatacg

SEQ ID NO: 794499 - DNA, 688 bp, Homo sapiens
  misc_feature: 80144.44.21.B10.1.pb.heavy.1.raw 80144
ctatgcgccttgccagcccgctcagacagtatataggagtagtccttgaccaggcagccagggccgctgtgcccccagaggtgctcctggagcagggcgccaggggaagaccgatgggcccttggtggaagctgaagagacggtgaccattgtccctggccccaaatatcaaatgcatcgacgtccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggcaagtgataatcactaagactgaatcctgagactacacaggagagtctcagagaccgccctggctgtgcaagcccccccccgactccgcagtcgccctcgcactggacaccttctaaaaaaactacaaggaaaatcaagattagcccaaactccatggttggtggtctgtgctcagtgctgatcaccaagtggaaactcctgggaatctcacggctggggctcctctctctttgcgacgacactaaatcgagcaccggtcgtgtatatactgtctgatggcgcgagggaggcgatacg

SEQ ID NO: 794500 - DNA, 717 bp, Homo sapiens
  misc_feature: 80157.44.56.F01.1.pb.heavy.1.raw 80157
ctatgcgccttgccagcccgctcagacagtatataggaagtagtccttgaccaggcagcccagggccgctgtgcccccagagggtgctcctggagcagggcgccaggggaagacccgatgggccccttggttggaagctgaagagacggtgaccattgtcccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacaggacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagcccccccgactccgccagtcgcccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 794501 - DNA, 705 bp, Homo sapiens
  misc_feature: 80159.44.36.D03.1.pb.heavy.1.raw 80159
cgtatcgcctcctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccagggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794502 - DNA, 547 bp, Homo sapiens
  misc_feature: 80164.UNK.UNK.UNK.pb.heavy.1.raw 80164
cgtatcgcctccctcgcgccatcagacagtatatacacaccggtgctcgatttagactagcagtaaggggctgaggtgaagaagcctggggcctcagtgaaggtctcctgcaaggcttctgatacacttcaccaattatgatatcaactgggtgcgacaggccactggacaagggcttgagtggatgggatggatgaaccctaacagtggtaacacaggctatgcacagaagttccagggcagaagtcaccatgacaggaacacctccataaacacagcctacatggagctgagcagctgagatctgaggacacggccgtgtattactgtgcgagatcccgaaagtatagcagctcggtcggggaggtggttcgacccctggggccagggaaccctggtcaccgtctcctcagcttccaccaagggccccatcggtcttccccctggcgccctgctccaggagcacctctgggggcacagcggccctggctgcctggtcaagactacttcctatatactgtctgagcgggctggcaaggcggcatag

SEQ ID NO: 794503 - DNA, 655 bp, Homo sapiens
  misc_feature: 80167.44.86.H09.1.pb.heavy.1.raw 80167
cgtatcgcctccctcgcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcgatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794504 - DNA, 698 bp, Homo sapiens
  misc_feature: 80170.44.36.D03.1.pb.heavy.1.raw 80170
cgtatcgcctccctcgcgccatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggactgcctggtcaaggactacttcctatatactgtctgagcgggctggcaaggcgcatag

SEQ ID NO: 794505 - DNA, 679 bp, Homo sapiens
  misc_feature: 80178.44.45.E01.1.pb.heavy.1.raw 80178
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggctccctggccccagtagaacgatgggctcgtacaataatagagagccgagtcctcggctctcaaattgttcattgttagatacacggtgttcttggattgtctctggagacggagaatcggcccttcacggaagtttccatagtattctttacttccatcagaccagatgactgccacccactccagccccttgcctggagcctggcggaccagtgcatggcagagtcactgaaactgagtccggacgcaacacaggagagtctcagggacgtcccaggctggaccacgcctccccagactccaccagctgaacctgacactggacacctcttaaagagcaacgaggaaaacccagctcagcccaactccatggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794506 - DNA, 778 bp, Homo sapiens
  misc_feature: 80179.UNK.UNK.UNK.pb.heavy.1.raw 80179
ctatgcgccttgccagcccgctcagaccaagtatataagccagtatgttataggagtcagtccttgaccagacagcccagggccgctgtgccccagaggtgctcttgaggaggtgccagggggaagaccgatggcccttggtggaggctgagcagacggcgaccttgtggtcccttggccccaggcgtccataccattgtgagtagagcatgtcatatcttgtatcacgaagccccatctctcgcacagtagatagacagccgtgtcctcggctctcaggctattcatttccagatattagtgtcgtttctttcgaattgtctctgaggatggtgaatcggcccttcaacggtatcttaacataatatttatttacttccatcctacaccatataagtgccacccactccagtcccttgcctggagcctggcgacccagtgcatgccatgtctgttgatgttgaaggttgaatccaggacgcttacacatcggagagagtctcagggcctccaggctgtaccaccgcctcccccagactccaccagcttcacctgacactggacaccttcttaaaagagcaacgaggaaaaacccaggtcagcccaaactccatggtgagtcctctgtggttcggtgctgatcaccgactggaaacacgccgacttctgtgctgggcctctctccaagacgctccccaacccaagtctatagcactaaatcgagccaccggtcgtgtatatactgtctgatggcgcgagcgggagggcgattacgatc

SEQ ID NO: 794507 - DNA, 678 bp, Homo sapiens
  misc_feature: 80180.44.45.E01.1.pb.heavy.1.raw 80180
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagagactcaccatggagtttgggctgagctgggttttcctcgttgctctttaagaggtgtccagtgtcaggttcagctggtggagtctgggggaggcgtggtccagcctggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggcctgggctgcctggtcaaggactacttcctatatactgtctgagcgggctggcaaggcgcatag

SEQ ID NO: 794508 - DNA, 688 bp, Homo sapiens
  misc_feature: 80183.UNK.UNK.UNK.pb.heavy.1.raw 80183
cgtatcgcctccctcgcgccatcagacagtatatacacgacgtgctcgatttagtagtcgcataaagggaaaggggagctctgagagaggagcccagccctggatttcaggtgtcttcatttgtgaccaggaccgaacagagagaagtctccatggagtttggctgagctgcctttttcttgtggctttttaaagggtgtcgtgtgtgaagtgcagttgttggagtctgggggggcctgattcggcctgggaggtccctgaccctctcctgtgcggcctctggattcaccttagtgctatggcatgacctgggtcgccgggctccagggaggggactggagtgggtctcaagtatcggagctggtggtgtcacttctacggagcccgtgaagggccgcttcaccattccagggacaattcgcaggacaaattgtttctccaaatgaaaacctgagacccgagacacaggcgtctattactgttgaaagccaggaccacgtgacccccatgacacctttagtacttggggccggggacagtgtgaccgtctcttcagcctccaccaagggcccatcggtcttcccctggcgccctgctccaggagcacctccgagagcacagcggccctgggctgcctggtcaaggactacttcctatatactgtctgagcgggctggcaggcgcatag

SEQ ID NO: 794509 - DNA, 576 bp, Homo sapiens
  misc_feature: 80188.UNK.UNK.UNK.pb.heavy.1.raw 80188
cgtatcgcctccctcgcgcgccatcagacagtatatacacgacggtggctcgatttagtgtggagtagtttcgggtttggtgccgaagttgctggggtcaacgtcaccacgcctgctgaggtgaagaagcctggggcctcagtgacagtctcctgcacggctttctggatacacgttcatcaattatgatattaactgggtgcgacggccgctggacatgggctggtaggtggatgggatggatgaagcctatagtggcaaccgggctttgccagaagttcgcaggcagagttagtatgaccaggagcaccctcccccaggtaacagtctacatgaactgagcagcctgaaatctaggacacggccgtgtatttctgtgcgagagccaccagcacctggcttgacttgtgggggccagggaaccctggtcaccgtctcctcagcctccaccaagggcccatcggtcttcccctggcgccctgctccaggagcacctccgagagcacagcggcccctgggctgcctggtcaaggactacttcctatatactgtctgagcgggctggcaaggcgcata

SEQ ID NO: 794510 - DNA, 729 bp, Homo sapiens
  misc_feature: 80189.44.33.C11.1.pb.heavy.1.raw 80189
cgtatcgcctccctcgcgccatcagacagtatatacacgaccggtgctcgatttagagtgagctcgttgggtttggggagctcttggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggcccgattcaccatctccagagacagattcgaagaacacactatatctggaaatgaatagcctgagagccgaggacacggctgtctactactgtggcgagagatggggctcgtggatacagatatgacatgctctactccaatggtatggacgcctgggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcggctggcaaggcgcatag

SEQ ID NO: 794511 - DNA, 667 bp, Homo sapiens
  misc_feature: 80197.UNK.UNK.UNK.pb.heavy.1.raw 80197
cgtatcgcctccctcgcgccatcagacagtatatacacgacggtgctcgatttagtagtgtagattccgcgggggctttctgagagtcatggacctcctgtgcaagaacatgaagcacctgtggttcttcctcctgctggtggcggctcccagatgggtcctgtccagctgcagctgcaggagtccgggcccaggactggtgaagccttcggagacccctgtccctcacctgcactgtctctggtggctccatcagcagtagtagttactactgggctggatccgccagcccccagggaagggggctggagtggattgggggtatctattatagtgggagcacctactacaacccgtccctcaagagtcgagtcaccatatcagttagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctggggctgcctggtcaagactacttcctatatactgtcctgagcgggctggcaaggcgcatag

SEQ ID NO: 794512 - DNA, 686 bp, Homo sapiens
  misc_feature: 80220.UNK.UNK.UNK.pb.heavy.1.raw 80220
ctatgcgcctgccagcccgctcagacagtatataggaagtagtccttgaccaggcagccagggccgctgtgctctcggagtgctcctggagcagggcgccaggggaagaccgatgggcccttgtggaggctgaggagacggtgaccagggttccctggcccaagtagtcaagcggggaccgtccgagggggctctcgcacaataatagacagccgtgtcctcacttgtgaggttgtacatttgcagatgcagtgtgttctggaattgtctctggagacggtgaatcggcccttctcggagtctccgtagtgttcttcaattccatcttctgatataattgccacccactccagccccttgccctggagcctgcggacccagtgcatggcataggtcctgaagatgaatccggaggtctgcacaggagagtctcaggaagttcccaggctgggcgctcctcccccagactcactagctgcacctgacactggccacctcttaaagagcaacgaggaaaacccatctcagcccaaagtccatggtgagtctctgtgtcagtgatgatcaccggaatggaaacaccgcgactgtccagtgctggctcgtctccccccctgagcgtagagctaaatcgagcaccggtcgttgtgtatatactgtctgatggcgcgagggaaggcgatacg

SEQ ID NO: 794513 - DNA, 645 bp, Homo sapiens
  misc_feature: 80223.44.19.B08.1.pb.heavy.1.raw 80223
cgtatcgcctccctcgcgccatcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaaggcccatcggtcttccccctggcgccctgctccaggagcacctccgagagcacagcggccctgggctgcctggtcaaggactacttcctatatactgtctgagcgggctggcaaggcgcatag

SEQ ID NO: 794514 - DNA, 645 bp, Homo sapiens
  misc_feature: 80230.44.23.C01.1.pb.heavy.1.raw 80230
cgtatcgcctccctcgcgccatcagacagtatatacacgaccggtgctcgatttagtacacgtgattagggattggggctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagtttccatcagttctgatcattcttgggctggatccggcagccccagggagggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggccgtggcaccctggtcactgtctcctcagcttccaccaagggcccatcggtcttcccctggcgccctgctccaggagcacctctgggggcacagcggccctggctgcctggtcaaggactacttcctatatactgtctgagcgggctggcaaggcgcatag

SEQ ID NO: 794515 - DNA, 607 bp, Homo sapiens
  misc_feature: 80237.44.36.D03.1.pb.heavy.1.raw 80237
cgtatcgcctccctcgcgccatcagacagtatataccacgaccggtgctcgatttagctgcgtcacgatctctcttgggtcttgtcccagggtcaccctgaaggagtctggtctgtgctggtgaaacccacagagaccctcacgctgacctgcaccatctctgggtctctctcaacgatacttaaatgggtgtgagctggatccgtcagcccccagggaaggcctggagtggcttgcacacatcttctcgaatgacgaaaatcctacagtacatctctgaagagcagtttaaccatctccaaggacacctccaaaaggcaggtgggtctttagtatgaccaacatggaccctgcggacacaggcacatattactgtgcacggtaaatgcggaaagaaacagctggtttctgtattataagtcttaccatctggacgtctgggtcaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcgcatag

SEQ ID NO: 794516 - DNA, 655 bp, Homo sapiens
  misc_feature: 80241.44.86.H09.1.pb.heavy.1.raw 80241
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggcccatagattgaaagaccagtctcgcctcgcacagaaataaacggccgtgtccgcggcggtcacggaggtcagtttcagggagaagcggttcatggacgtgtccctcgaaatggtgagacgactcttgagggacggaggaagtagtacgtcgccccagtataatggatgtcaccaatccactccattccctccctggggggctgccggatccaggccaagaatgatcagaactgatggaactccagagacagtgcagatgagagacagggttcccgaaggcctcacagtcctgggccccgactcctgcagctgcacctgggacaggacccatctgggagctgccaccagcaggaggaaaaaccacaggtgcttcatgttcttgcacaggaggtccttgactctcagaaagcatcccccaaacccagagtctatagcactaaatcgagcaccggtcgtgtatatactgtctgatggcgcgagggaggcgatacg

SEQ ID NO: 794517 - DNA, 609 bp, Homo sapiens; identical to SEQ ID NO: 793357
  misc_feature: 80247.UNK.UNK.UNK.pb.heavy.1.raw 80247

SEQ ID NO: 794518 - DNA, 697 bp, Homo sapiens
  misc_feature: 80297.44.85.H08.1.pb.heavy.1.raw 80297
cgtatcgcctccctcgcgccatcagacagtatatacacgaccggtgctcgatttagtatcactcagtcgcgggggctctggagaggagcccagactagagtcggcgtgtttccattcggtgatcagcactgaacaagaggactcacatggagtttgggagctggtttcctcgttgctctttaaagtgtccagtgtcaggtgcagctggtggagtctgggggaggcgtggtccagcctgggaggtccctgagactctcctgtgcagcgtctggattcacctcagtacctatggcatgcactgggtccgccaggtccaggcaagggctggagtggtggctttatggatggaataaaaatactagcagactccgtgaagggccgatcaccatcccaggacacttccaaaaacacgctgtatctgcaaatgaacagcctgagagccgaggacacggccgtgtattactgtgcgaggacatattgtagtactaccacctgctgggactactactacggtatggacgtctggggccaaggggaccacggtcaccgtctccctcccagctccaccaagggcccatcggtccttccccctggcaccctcctccagagcacctctgggggcacagcgggccctgggctgcctggtcaaggactacttcctatatactgtctggcggcggctggccaaggcgcatag

SEQ ID NO: 794519 - DNA, 703 bp, Homo sapiens
  misc_feature: 80334.44.56.F01.1.pb.heavy.1.raw 80334
ctatgcgccttgccagcccgctcagacagtatataggaagtagtccttgacaggcagcccaggccgctgtgccccagaggtgctcctggagcaggcgcaggggaagaccgatgggcccttggtggaagctgaagagacggtgaccattgtccctggccccaaatatcaaatgcatcgacgtcccaggatcgcctggcgcagtaatagacgcctgtgtcgtcgggtctcaggttgctcatttgtaaatggccaacactgttggagtcatcccttgagacggtgaatcttcccttcacagacgcggcgtactctttacttccaccataacgtttcattctgacgaaagtgatccactcaagcccttccctggagcctgacggacccaggccaagtgataatcactaagactgaatcctgagactacacaggagagtctcagagaccgccctggctgtgccaagccccccccgactccgccagtcgccctcgcactggacaccttctaaaaaactacaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 794520 - DNA, 695 bp, Homo sapiens
  misc_feature: 80356.UNK.UNK.UNK.pb.heavy.1.raw 80356
ctatgcgccttgccagcccgctcagacagtatataggaagtagtccttgaccaggcagcccagggccgctgtgcccccagagtgctcttggaggagggtgccagggggaagacgatgggccttggtggaggcggaggcgacggtgaccagggttccctggccccagaagtcaaacgaataataaccactccgagcgccgacttgtctcgcacagtaatagacggccgtgtcgtcgcctctcaggttgttcattgaagataaaccgtgttcctggaattgtccctggagatggtgaatcggcccttcacggagtctgcgtagtatgtgaaatcaccagtataaatgactgagacccactccagccccttccctggagcctggcggacccaactcatgtagttgctgctgacggtgagccagaggctgcacaggagagtctctggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccgtcgtgtatatactgtctgatggcgcgagggaggcgatacg

SEQ ID NO: 794521 - DNA, 703 bp, Homo sapiens
  misc_feature: 80373.44.55.E11.1.pb.heavy.1.raw 80373
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794522 - DNA, 703 bp, Homo sapiens
  misc_feature: 80375.44.36.D03.1.pb.heavy.1.raw 80375
cgtatcgcctccctcgcgccaatcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtccctgagactctcctgtgtcgcctcctggattcaccatcagtgaccactatattgggacttgggtccgccaggctccaggaaggggctggagtggcttggccgcagtaaaaacaaagttgccagctttatcacagagtacgccgcgtctgtgaaagccagattcaccctctcaagagatgacttcaagaaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794523 - DNA, 702 bp, Homo sapiens
  misc_feature: 80376.44.27.C05.1.pb.heavy.1.raw 80376
cgtatcgcctccctcgcgccatcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 794524 - DNA, 654 bp, Homo sapiens
  misc_feature: 80387.UNK.UNK.UNK.pb.heavy.1.raw 80387
cgtatcgcctccctcgcgccatcagacatatatacacgaccgtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgccgcttctccctgaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctggggcacagcggccctgggctgcctggtcaaggactacttcctatatactgtctgagcgggctggcaaggcgcatag

SEQ ID NO: 794525 - DNA, 654 bp, Homo sapiens
  misc_feature: 80392.44.70.G04.1.pb.heavy.1.raw 80392
cgtatcgcctccctcgcgccatcagacagtatatacacgaccggtgctcgatttagtgtagtgtgaagggaaagggggactcctgtgcccccaccatggacacactttgctccacgctcctgctgctgaccatcccttcatggggcctgtcccagatcaccgtgaaaagagtctggccctacattggtgaaacccacacagaccctcacgctgacctgcacccgtctcaggcttctcactcgtcactcctgggagggcgttgtctgggtgcggcagccccccggaaaggccctggaagtggatcgcactcacttattggaatgacgatatacgatatagtccttctctgacgacagactcacgctcacgaaggacacgtccaaaaaccaggtggtccttacatgaccaacgtggacctgtggacacaggcacatatttctgtgcccacttcatgaccacaatgaccacgggcttcttcgaaccctggggccagggaatccaggtcaccgtctcatcagcctccaccaagggcccatcggtcttccccctggcgcccctgctccaggagcacctccgagagcacagcggccctgggctgcctggtcaaggactacttcctatatactgtctgagcggggctggcaaggcgcatag

SEQ ID NO: 794526 - DNA, 696 bp, Homo sapiens
  misc_feature: 80412.44.74.G08.1.pb.heavy.1.raw 80412
cgtatcgcctccctcgcgccatcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccttttcctgcacggcctctggaagtactaccagttccactacttataccatcaactgggtgcgccaggcccctggacaagggcttgagtggatgggtggaatcatcctctttttggctcactcacctacgcacgagacttccggggcagaattacgattaccgcggacaagtccacagacacagtctccatgacaatgagttctttgaaatccgacgacacggcgtctactactgtgcgagaggtccgtaccccagctcgcatggagcctttgagaatctgggggccagggaaccctggtcattgtcacctcaggcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794527 - DNA, 547 bp, Homo sapiens
  misc_feature: 80438.44.43.D10.1.pb.heavy.1.raw 80438
cgtatcgcctccctcgcgccatcagacagtatatacacgaccggtgctcgatttagactagcagtaaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacaccctccataaacacaggcctacatggagctgagcagcctgagatctgaggacacggccgtgtattactgtgcgagatcccgaaagtatagcagctcgtcggggaggtggttcgaccctggggccagggaaccctggtcaccgtctcctcagcttccaccaagggcccatcgtcttcccctggcgccctgctccaggagcacctctggggcacagcggccctgggctgcctggtcaagactacttcctatatactgtctgagcgggctggcaaggcgcatag

SEQ ID NO: 794528 - DNA, 723 bp, Homo sapiens
  misc_feature: 80460.UNK.UNK.UNK.pb.heavy.1.raw 80460
cgtatcgctccctccgcgccatcagacagtatatacacgaccggtggctcgatttagtatcactcagtcgcggggagctctgggagaggagccagcactagaagtcggcgggtttccattcggtgatcagcactgaacacagaggactcaccatggagtttgggctgagctgggttttcctcgttgctcttttaagaggtgtccagtgtcaggtgcagctggtggagtctgggggagggcgtggtccagcctgggaggtccctgagactctcctgtgcagcgtctggattcaccttcagtacctatggcatgcactgggtccgccaggcccaggcaaggggctggagtgggtgggcacttatatggtatgatggaagtaataaatactatgccagactccgtgaagggccgatcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcacccctctccaagagcacctctgggggcacagcggcctgggctgcctggtcaaggactactttcctatatactgtctgagcgggctggcaaggcgcatag

SEQ ID NO: 794529 - DNA, 731 bp, Homo sapiens
  misc_feature: 80469.44.33.C11.1.pb.heavy.1.raw 80469
cgtatcgcctccctcgcgccatcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctggggggcacagcggccctgggctgcctggtcaagactacttcctatattactgtctgagcgggctggcaaggcgcatag

SEQ ID NO: 794530 - DNA, 672 bp, Homo sapiens
  misc_feature: 80485.44.35.D02.1.pb.heavy.1.raw 80485
cgtatcgcctcctcgcgccatcagacagtatatacacgaccggtgctcgatttagcacacgatagttggtttggggatactttctgagactcatgggcctcctgcacaagaacatgaaacacctgtggttcttcctcctcctggtggcacctcccagatgggtcgtgtccgaggtgcagctgcaggagtcgggccaggacgggtgaagccttcggagaccctgtccctcacctgcaatgtctctggtggttacatcagtagttattattggagttggctgccggcagtccgccgggaagggactggagtggattgggcgcatctataacagtggcagcaccaactacaaccccgccctcaagagtcgagtcaccatgtcactagacaggtcaagaaccagttctccctgaaattgacttctgtgaccgccgcggacacggccgtatattattgtgcgagagattcctatcgatacagtagagacggggggcgaactggctcgaccctgggccagggaaccctggtcaccgtctcctcagcctcaccaagggcccatcggtcttccccctggcaccctccttccaagagcacctctgggggcacagcggccctggctgcctggtcaaggactacttcctatatactgtctgagcgggctggcaaggcgcatag

SEQ ID NO: 794531 - DNA, 699 bp, Homo sapiens
  misc_feature: 80488.UNK.UNK.UNK.pb.heavy.1.raw 80488
cgtatcgccctccctcgcgccatcagacagtatatacacgaccggtgctcgatttagacgcgcgatcgaagggtttggggggaagaggaagtcgccgtgttttccactcggtgatcatcactgaacacagaggactcaccatggagtttgggctgagctgggttttcctcgttgccctcttaagaggtgtcatgtgtcaggtgcaattcgtggagtctggggggaggcgtgccccagtaggggggtccctgaggactctcctgtgcagcctctggattcacccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactaatctgtttccaaaatcggttcattcgacgccctggggccagggaaccctggtcaccgtctcctcggcctccaccaagggcccatcggtcttccccctggcgccctgctccaggagcacctccgagagcacagcggccctgggctgcctgggtcaagggactacttcctatatactgtctgagcgggctggcaaggccgcatag

SEQ ID NO: 794532 - DNA, 649 bp, Homo sapiens
  misc_feature: 80502.UNK.UNK.UNK.pb.heavy.1.raw 80502
cgtatcgcctccctcgcgccatcagacagtatatacacgaccggtgtcgatttagtagtctcataagggaaatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctcctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactactttcctatatactgtctgagcgggctggcaaggcgcatag

SEQ ID NO: 794533 - DNA, 703 bp, Homo sapiens
  misc_feature: 80508.44.27.C05.1.pb.heavy.1.raw 80508
cgtatcgcctccctcgcgccatcagacagtatatacacgaccggtgctcgatttagacgcgatcgaagggtttggggctgggagacgagccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagactcaggacacggccgtgtattttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794534 - DNA, 605 bp, Homo sapiens
  misc_feature: 80517.UNK.UNK.UNK.pb.heavy.1.raw 80517
gaaggctgggcaggctatgcaccctggtccaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacaccccaagcaggctatgtggggggtgataggggtggatctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtcctagcaagcgtgtcggg

SEQ ID NO: 794535 - DNA, 693 bp, Homo sapiens
  misc_feature: 80530.44.53.E09.1.pb.heavy.1.raw 80530
cgtatcggcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggatttttccttgctgctattttaaaaggtgtccagtgtgaggtgcagttggtggagtctgggggaggtttggtaaagcctggggagtcccttagactctcctgtgcagcctctggattcacttttcagtaacgcctggatgacctgggtccgccaggctccagggaaggggcctggagtgggttggccgtattagaaccaaaggctgacggtgggacagcagactacgctgcaccccgtgaaaaggcagattcaccatctcaagagatgattcaaaagatacggtgtctctgcagatgaacagcctgaacaccgaggacacagccgtctattactgtctgggatggttttcatttcgggccagggaaccctggtcaccgtctcctccagcctccaccaagggcccatcggttcttccccctggcgccctgctccaggagcacctccgagagcacagcggccctggctgcctggtcaaggactacttcctatatactgtctgagcgggctggcaaggcgcatag

SEQ ID NO: 794536 - DNA, 662 bp, Homo sapiens
  misc_feature: 80546.44.23.C01.1.pb.heavy.1.raw 80546
ctatgcgccttgccagcccgctcagacagtatataggaagtagtccttgaccaggcagccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattccctccctggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagccccaatccctaatcacgtgtactaaatcgagcaccggtcgtgtatatactgtctgatggcgcgagggaggcgatacgctgtcagtctctc

SEQ ID NO: 794537 - DNA, 606 bp, Homo sapiens
  misc_feature: 80549.44.36.D03.1.pb.heavy.1.raw 80549
cgtatcgcctccctcgcgcctcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794538 - DNA, 716 bp, Homo sapiens
  misc_feature: 80557.44.85.H08.1.pb.heavy.1.raw 80557
cgtatcgcctccctcgcgccatcagacagtatatacacgaccggtgctcgatttagtatcactcagtcgcggggagctctgggagaggagcccagcactgaagtcggcggtgtttccattcggtgatcagcactgaacacagaggactcaccatggagtttgggctgagctgggttttcctcgttgctcttttaagaggtggtccagtgtcaggtgcagctggtgagtctgggaggcgtggtccagcctgggaggtccctgagactcctggcaggtctggattcaccttcagtacctatggcatgcactgggtccgccaggctccaggcaaggggctggagtgggtggcactatatggtatgatggaaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacgggtcaccgtctcctcagcctccaccaagggcccatcggtcttccccctggcaccctcctccaaggagcacctctgggggcacagcgccctgggctgcctgtcaaggactacttcctatatactgtctgagcgggctggcaaggcgcatag

SEQ ID NO: 794539 - DNA, 698 bp, Homo sapiens
  misc_feature: 80572.44.27.C05.1.pb.heavy.1.raw 80572
tatgcgccttgccagccgctcagacagtatataggaagtagtccttgaccaggcagcccagggccgctgttgctctcggaggtgctcctggagcagggcgccagggggaagaccgatgggcccttggggaggccgagagacggtgaccagggttccctggcccaggcgtcgaatgaaccgattttggaaacagatagtctcgcacaaaaataccacggccgtgtcctgaggtctcaggctgttcatttgaagagacactgtgttccggaattgtctctggagatggtgaatcggccctcaacggaatcaccgtagacttgatttcctccatgaaatgacacacctgccacccactccagccctcgcctggagcctgcggacccactgcatattccaattatcgaaggtgaatccagaggctgcacagggagtctcagggcccccctactggggccacgcctcccccagactccacgaattgcacctgacacatgacacctcttaagagggcaacgaggaaaacccagctcagcccaaactccatggtgagtcctctgtgttcagtgatgatcaccggagtggaaacaccggcgacttccagtgctgggctcgtctcccagggccccaacccttcgatcgcgtctaaatcgagcaccggtcgtgtatatactgtctgatggcgcgagggaggcgatacg

SEQ ID NO: 794540 - DNA, 681 bp, Homo sapiens
  misc_feature: 80580.44.45.E01.1.pb.heavy.1.raw 80580
ctatgcgccttgccagcccgctcagacagtatataggaagtagtccttgaccaggcagcccaggccgctgtgctctcggaggtgctcctggagcagggcgccaggggaagaccgatgggcccttggtggaggctgaggagacggtgaccagggctccctggccccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctccccagactccaccagctgaacctgacactggacacctcttaaaagagcaacgagaaaaacccagctcagcccaaactccattggtgagtcctctgtgttcagtgctgatcaccgaatggaaacaccgccgacttctagtgctgggctcctctcccagcccctttcccttactgactcactaaatcgagcaccggtcgtgtatatactgtctgatggcgcgagggaggcgatacg

SEQ ID NO: 794541 - DNA, 697 bp, Homo sapiens
  misc_feature: 80586.44.27.C05.1.pb.heavy.1.raw 80586
ctatgcgccttgccagcccgctcagacagtatataggaagtagtccttgaccaggcagcccagggccgctgtgctccgaggtgctcctggagcagggcgccaggggaagaccgatgggcccttggtggaggccgaggagacggtgaccagggttccctggccccaggcgtcgaatgaaccgatttggaaacagatagtctcgcacaaaatacacggcgtgtcctgaggtctcaggctgtcatttgaagagacactgtgttctcggaattgtctctggagatggtgaatcggccctcaacggaatcaccgtagacttgatttcctccatgaaatgacacacctgccacccactccagccctcgcctggagcctggcggacccactgcatattccaattatcgaaggtgaatccagaggctgcacaggagagtctcagggacccccctactggggccacgcctcccccagactccacgaattgcacctgacacatgacacctcttaagagggcaaacgaggaaaacccagctcagcccaaactccatggtgagtcctctgtgttcagtgatgatcaccgagtggaaacaccggcgacttccagtgctgggctcgtctcccagccccaaacccttcgatcgcgtctaaatcgagcaccggtcgtgtatatactgtctgatggcgcgagggaggcgatacg

SEQ ID NO: 794542 - DNA, 685 bp, Homo sapiens
  misc_feature: 80587.44.27.C05.1.pb.heavy.1.raw 80587
ctatgcgcttgccagcccgctcagacagtatataggagtagtccttgaccaggcagcccaggccgctgtgctctcggaggtgctcctggagcagggcgccaggggaagaccgatgggccctggtggaggccgaggagacggtgaccaggttccctggccccaggcgtcgaatgaaccgatttggaacagatagtctcgcacaaaaatacacggccgtgtcctgaggtctcaggctgttcattgaagagacactgtgttctcggaattgtctctgagatgggaatcggccctcaacggaatcaccgtagacttgatttcctccatgaaatgacacacctgccacccactccagcccctcgcctggagcctggcggacccactgcatattccaattatcgaggtgatccagagggctgcacaggagagtctcagggacccccctactgggccacgcctccccagactccacgaatgcacctgacacatgacacctcttaagagggcaacgagaaaacccagctcagccaaactccatggtgagtcctctgtgttcagtgatgatcaccgagtggaaacaccggcgacttccagtgctgggctcgtctccaggccccaaacccttcgatcgcgtctaatcgagcaccggtcgtgtatatactgtcgatggcgcgagggaggcgatacg

SEQ ID NO: 794543 - DNA, 657 bp, Homo sapiens
  misc_feature: 80589.44.23.C01.1.pb.heavy.1.raw 80589
cgtatcgcctccctcgcgccatcagacagtatatacacgaccggtgctcgatttagtacacgtgattagggattggggggctttctgagagtcaaggacctcctgtgcaagaacatgaagcacctgtggttttttcctcctgctggtggcagctcccagatgggtcctgtcccaggtgcagctgcaggagtcgggcccaggactggtgaggcctcgggaaccctgtcttctcatctgcactgtctctgaagtttccatcaagttctgatcattcttgggggctggatcggcagccccccagggaggggaatggagtggattggtgacatccattatactggggcgacgtactactctccgtccctcaagagtcgtctcaccatttcgagggacacgtccatgaaacgcttctccctgaaactgacctccgtgaccgccgcggacacggcccgtttatttctgtgcgaggcgagactggtctttcaatctatggggccgtggcaccctggtcactgtctcctcagctttccaccagggcccatcggtcttccccctggcgccctgctccaggagcacctctgggggcacagcggccctggctgcctggtcaaggactacttcctatatactgtctgagcgggctggcaaggcgcatag

SEQ ID NO: 794544 - DNA, 576 bp, Homo sapiens
  misc_feature: 80592.UNK.UNK.UNK.pb.heavy.1.raw 80592
ctatgcgccttgccagcccgctcagacagtatataggaaagtagtccttgaccaggcagccagggccgctgtgctctcggaggtgctcctggagcaggcgccagggggaagaccgatgggcccttggtggaggctgaggagacggtgacagggttccctggcccacaagtcagccaggtggctggtggctctcgcacagaaatacacgcccgtgtcctcagatctcaggctgctcagttccatgtagactgtacctggggaggtgctcctggtcataactaactctgccttggaacttctggcaaagcccgtgttgccactatagggcttcaatccatcccatccactccagcccttgtccagcggcctgtcgcacccagttaataatcataattgatgaacgtgtatccagaagccgtgcaggagactgtcactgaggccccaggcttcttcacctcagcagcgtggtgaccgtgacctccagcaacttcggcacccaaacccaaacctacctcaccactaaatcgagcaccggtcgtgtatatactgttctgatggcgcgagggaggcgatacg

SEQ ID NO: 794545 - DNA, 689 bp, Homo sapiens
  misc_feature: 80595.44.33.C11.1.pb.heavy.1.raw 80595
aggaagtagtccttgaccaggcagcccagggccgctgtgccccagaggtgctcttggaggagggtgccaggggaagaccgatgggcccttggtggaggctgaggagacggcgaccgtggtcccttggcccaggcgtccataccattggagtagagcatgtcatatctgtatccacgagccccatctctcgcacagtagtagacagccgtgtctcggctctcaggctattcatttccagatatagtgtgttcttcgaattgtctctggagatggtgaatcggcccttcacggaatctacataatatttattacttccatcataccatataagtgccacccactccagtccttgcctggagcctggcggacccagtgcatgccatgtctgttgaaggtgaatccagacgctacacaggagagtctcaggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctggctcctctcccagagctccccaaacccaacgagctcactctaaatcgagcaccggtcgtgtatatactgtctgatggcgcgagggaggcgatacg

SEQ ID NO: 794546 - DNA, 676 bp, Homo sapiens
  misc_feature: 80596.44.71.G05.1.pb.heavy.1.raw 80596
ctatgcgccttgccagcccgctcagacagtatataggaaagtagtccttgaccaggcagcccagggccgctgtgcccccagaggtgctcttggaggagggtgccagggggaagaccgatgggcccttggtggaggctgaggagacggtgaccggggtccctttgccccagacgtccatgtagtagtaatacttgtattgttgtaacttctgcgaccctctggcacagtaataaagggccgtggtcgtccactcgcaggctcttcatctgcagaaacaccgtattcttggaattgtccctggagacgatgaagcggcccttcacggagtctgcgacatttgtggcactaccaccagtaatggatgagacccactccagccccttccctggggcctgacggacccagatcatggcataggtattaaaggcgaatccagaggctgcacaggagagtgtcagggaccccccggctgtaccaagcctccccccgactccaacagctgcacttcacactggacaccttttaaaacagccacaagaaaaagccagctcagcccaaactccatggtgagttctctctgttcagtccccagggctgggctcctctctcttgcgacgacactaaatcgagcaccggtcgtgtatatactgtctgatggcgcgagggaggcgatacg

SEQ ID NO: 794547 - DNA, 695 bp, Homo sapiens
  misc_feature: 80597.UNK.UNK.UNK.pb.heavy.1.raw 80597
cgtatcgcctccctcgcgccatcagacagtatatacacgacgtgctcgattagcacctcgcacgtgggtttgggggggagaggagcccagcactgggattccgaggtgtttccattcggtgatcagcactgaacacagaggactcaccatggagttttggctgagctggttctccttgttggactttaaaaggtgtccagtgtgaggtgcggctgatggagtctggaggaggcttagtccagcctggggtccagagactctcctgtgcagcctctgggctcaccgtcagcagcactacatgagttgggtccgccagctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgttttgacttctgggccagggaaccctggtcaccgtcgcctccgcctccaccaagggccatcggtcttccccctggcaccctcctccaagagcacctctgggggcacagcggccctgggctgcctggtcaaggactacttcctatatactgtctgagcgggctggcaaggcgcatag

SEQ ID NO: 794548 - DNA, 691 bp, Homo sapiens
  misc_feature: 80600.UNK.UNK.UNK.pb.heavy.1.raw 80600
cgtatcgcctccctcgcgccatcagacagtatatacacgaccggtggcgctcgatttagcacacgatagttggcgtttggggatactttctgagactcatggcctcctgcacaagaacatgaaacacctgtggtttcttcctcctcctggtggcacctcccagatgggtcgtgtccgaggtgcagctgcaggagtcggccccaggacgggtgaagccttcggagacccctgtccctcacctgcaatgtctctggtggttacatcagtagttattattggagttggctgcggccagtccgccggaagggactggagtggattgggcgcatctataacagtggcagcaccaactacaacccgcctcaagagtcgagtcaccatgtcactagacaggtccaagaacgcagttctccctgaaattgacttctgtgaccgccgcggacacggccgtatattattgtgcgagagattcctatcgatacagtagagacggggggggcgaactggctcgaccctggggccagggaacccctggtcaccgtctcctcagcctcccaccaaagggccatcggtcttcccctggcaccctcctccaagagcacctctgggggcacagcgggcctgggctgcctggtcgaaggactacttcctatatacccctgtctgagcgggctggcaaggcgccgatagg

SEQ ID NO: 794549 - DNA, 611 bp, Homo sapiens
  misc_feature: 80615.UNK.UNK.UNK.pb.heavy.1.raw 80615
ccgacacgcttgctagggacttggagctaaggacgacatattgcctttagacagtcgaaggtgacgccttagctaccactgaacgtttaggcgccagatgcggtctgggatgacctaactcgcagcttatcgatgatctactggcacgctcaaccaaccaggtcttgatgcgcgcgataggactgacgggatcgctacagacatttaactcgctagtaacttaattgagatcctaggggatgggataggaaatagaatccacccctatcacccccccccacatagcctgcttggggtgttgagtttacttttatttcgtgttggaatgagttgaacttccggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggaccccctagtggccaagatggccgctagcgcggttccgcagcttttgacctggaccagggtgcatagcctgcccagccttc

SEQ ID NO: 794550 - DNA, 674 bp, Homo sapiens
  misc_feature: 80616.UNK.UNK.UNK.pb.heavy.1.raw 80616
tctatgcgccttgccagcccgccagacagtatataggaagtagtccttgaccaggccaggcccagggccgctgtgcccccagaggtgctcttggaggagggggtgccggggggaagaccgatggccctggtggaggctgaggagacggtgaccagggttccctggccccagtggtcaagtagtcgggtgacgaactgcgactgcctactctcgcacagtaatacacggccgtgtccgcggcgtcacagagctcagcttcagggagaactggttcttggacgtgtctactgatatggtgacctcgactcttcgagggacgggtttgtagtaggtgctcccactataatagatactccaatccactcgcagccccttcctggggctggcggatccaggccccagtagtaactactactggctgatggagccaccagagaccaggtgcagggtgagggacagggtctccgaggcttcaccagtcctgggccgactcctgcagctgcagctgggacaggacccatcctgggagccgccacagcaggaggaagaaccacaggtgcttcatgtcttgcacagaggtccatgactctcagaaagcccccgcggcaatctacactactaaaatcgagcacccgtcgtgttatactgtctgatggcgcgagggaggcgatacg

SEQ ID NO: 794551 - DNA, 699 bp, Homo sapiens
  misc_feature: 80620.44.55.E11.1.pb.heavy.1.raw 80620
ctatgcgcctgccagcccgctcagacagtatataggaagtagtccttgaccaggcagcccagggccgctgtgcccccagaggtgctcttggaggagggtgccagggggaagaccgatgggcccttggtgaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcgcccttcacggagtctgcgtagtatgtgaaatcaccagtataaatgactgagacccactccagccccttccctggagcctggcagacccaactcatgtagttgctgctgacggtgagcccagaggctgcacaggagagtctctgggaccccccaggctggactaagcctcctccagactccatcagccgcacctcacactggacaccttttaaaagtccaacaaggagaaccagctcagccaaaactccatggtgagtccctctgtgtcagtgctgatcaccgaatggaaacacctcggaatcccagtgctgggctcctctccccaaacccaacgtgcgagtgctaaatcgagcaccggtcgtgtatatacgtctgatggcgcggagggaggcgatacg

SEQ ID NO: 794552 - DNA, 710 bp, Homo sapiens
  misc_feature: 80629.44.56.F01.1.pb.heavy.1.raw 80629
cgtatcgcctccctcgcgccatcagacagtatatacacgaccggtgctcgatttagcagacgtctgaacacacaaaggggagctctgggagaggagcccagccgtgagattcccaggagtttccacttggtgatcagcactgagccacagaccaccaaccatggagtttgggctaatcttgattttccttgtagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttgccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctcaggagcacctctggggcacagcggccctggctgcctggtcaaggactacttcctatatactgtctgagcgggctggcaaggcgcatag

SEQ ID NO: 794553 - DNA, 610 bp, Homo sapiens
  misc_feature: 80641.UNK.UNK.UNK.pb.heavy.1.raw 80641
gaaggctgggcaggctatgcaccctggtccaggtcaaaagctgcggaacccgctagcggccatcttggccactaggggtccgcagattcaatattgtcgtctagcatgcacaatgctgcaaacccagcttgcaatgcccacagcaagcggccaatctttacgccacgttgaattgtttattacctgtgactggctatggctttgcaacgccactcgtaaaactagtactttgcggttaggggaagtagacaaacccattactccacttcccggaagttcaactcattccaacacgaataaaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcggtgcagtagatcatcgataagctgcgagttaggtcatccagaccgcatctggcgcctaaacgtttcagtggtagctaaggcgtcaccttcgactgtctaaaggcaatatgtcgtccttagctccaagtccctagcaagcgtgtcggg

SEQ ID NO: 794554 - DNA, 704 bp, Homo sapiens
  misc_feature: 80652.44.73.G07.1.pb.heavy.1.raw 80652
ctatgcgccttgccagcccgctcagacagtatataggaagtagtccttgaccaggcagcccagggccgctgtgctctcggaggtgctcctggagcagggcgccaggggaagacgcgatgggcccttggtggaggctgaggagacggtgaccagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggcccttcacggagtctgcataatatctagaagttccatcatattgctataactgccaacactccggccccttgcctggagcctggcggacccagtgcatgccagaactactgaaactaaatccagaggcttcacaggagagtctcaggacctcccaggctggaccacgcctccccagactccaccaggtgcacctgacactggacacctcttaaaagagtaacgaggaaacccagctcagccaaactccatggtgagtcctctgtgttcagtgctgatcaccgaatggaaacaccgccgacttctagtgctgggctcctctcccagagctccctgagcgtagagctaaatcgagcaccggtcgtgtatatactgtctgatggcgccgcggagggaggcgatacg

SEQ ID NO: 794555 - DNA, 649 bp, Homo sapiens
  misc_feature: 80653.44.23.C01.1.pb.heavy.1.raw 80653
cgtatcgcctccctcgcgccatcagacagtatatacacgaccggtgctcgattagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcgacacggccgtttatttctgtgcgaggcgagactggtctttcaatctatgggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794556 - DNA, 659 bp, Homo sapiens
  misc_feature: 80654.44.86.H09.1.pb.heavy.1.raw 80654
cgtatcgcctccctcggcgccatcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggggaaccctgtctctcatctgcactgtctctggagtttccatcagttctgatcatcttgggctggatccggcagccccaggggaggggaatggagtggattggtgacatccattatactggggcgacgtactaactctccgtccctcaagagtcgtctcaccatttcgagggacacgtccatgaaccgcttctccctgaaactgagcctccgtgacgcgccgcggacacggccgtttatttctgtgcgaggcgagactggtctttcaatctatggggccgtggccaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794557 - DNA, 653 bp, Homo sapiens
  misc_feature: 80658.44.23.C01.1.pb.heavy.1.raw 80658
ctatgcgccttgccagcccgctcagacagtatataggaagtagtccttgaccaggcagcccagggccgctgtgccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagttttcagggagaagcggttcatggaccgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcactgggacaggacccatctgggagctgccaccagcaggaggaaaaaccacaggtgcttcatgttcttgcacaggaggtccttgactctcagaaagcccccaatccctaatcacgtgtactaaatcgagcaccggtcgtgtatatactgtctgatggcgcgagggaggcgatacg

SEQ ID NO: 794558 - DNA, 700 bp, Homo sapiens
  misc_feature: 80663.UNK.UNK.UNK.pb.heavy.1.raw 80663
ctatgcgcctgccagcccgctcagacagtatataggaagtagtccttgaccaggcagcccagggccgctgtgctctcggaggtgctcctggagcagggcgccagggggaagaccgatgggcccttgtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctgggcaactttgtttttactgcggccaagccactccagccccttccctggagcctgggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaaccagctcagcccgaactccatggtgagtcctctgtgttcagtgctgatcaccaaatgaaaaacacctgggaattctgggggctggggctccgctctcccccagagagatcgtgacgccagctaaatcgagcaccggtcgtgtatatactgtctgatggcgcggagggaggcgatacg

SEQ ID NO: 794559 - DNA, 605 bp, Homo sapiens
  misc_feature: 80667.44.36.D03.1.pb.heavy.1.raw 80667
cgtatcgcctcctcgcgccatcagacagtatatacacgaccggtgctcgatttagctgcgtcacgatctctcttggggtcttgtcccaggtcaccttgaaggagtctggtcctgtgctggtgaaaccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcggaaagaaacagctggtttctgtattataagtcttaccatctggacgtctggggcaaaggaccacggtcaccggtctcctcagcttccaccaagggcccatcggtcttccccctggcgccctgctccaggagcacctctgggggcacagcggccctgggctgcctggtcaaggactacttcctatatactgtctgagcggctggcaaggcgcatag

SEQ ID NO: 794560 - DNA, 675 bp, Homo sapiens
  misc_feature: 80680.UNK.UNK.UNK.pb.heavy.1.raw 80680
cgtattacggcctccctcggcggcatcagacaggtatcagatacacgaccggtgcctcgattttagtgctatagacttgggtttggggatgctttctgagagtcaaggaccgaaattcctgtgcaagaacatgaagcacctgtggttttttcctcctgctggtggcagctcccagatgggtcctgtcccaggtgcagctgcaggagtcgggcccaggaactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactgtgtctttcaatctatggggccgtggcaccctggtcactgtctcctcagcttccaccaagggcccatcggtcttccccctggcgccctgctccaggagcacctctgggggccacagcggccctggcctgcctggtcaagggactacttccctatatactgtctgagcgggctggcaagcgcatag

SEQ ID NO: 794561 - DNA, 573 bp, Homo sapiens
  misc_feature: 80687.44.78.H01.1.pb.heavy.1.raw 80687
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccacaagtcaagccaggtgctggtggctctcgcacagaaatacacggccgtgtcctcagatctcaggctgctcagttccatgtagactgtacctggggaggtgctcctggtcatactaactctgccttggaacttctgggcaaagcccgtgttgccactatagggcttcatccatcccatccactccagcccttgtccagcggcctgtcgcacccagttaatatcataattgatgaacgtgtatccagaagccgtgcaggagactgtcactgaggccccaggcttcttcacctcagcagcgtggtgaccgtgacctccagcaacttcggcacccaaacccaaactactcacactaaatcgagcaccggtcgtgtatatactgtctgatggcgcgagggaggcgatacg

SEQ ID NO: 794562 - DNA, 698 bp, Homo sapiens
  misc_feature: 80712.UNK.UNK.UNK.pb.heavy.1.raw 80712
cgtatcgcctcccgcgcagtcgcatcagtatattacgagcgacggtgggctccgatttagctgcgtcacgatctctcttgggagctctcagagaggtgccttagccctggattccaaggcatttccacttggtgatcagcactgaacacagaggactcaccatggagttggggctgcgctggttttccttgttgctatttagaaggtgtccactgtgaggtgcggctggtggagtctggggaggcttggtacagccggggggggtccctgagactctcctgtgcagctctggattcatctcagtgactagcatgaactgggtcgccaggctccagggaagggctggagtgggtttcatatgttaatattgctggagataccacctactacgcagactctgtgaaggccgatcaccaattcagggacaatgccaagaactcactgtatctggaaatgaacagctgagagacgaggacacggctgtctacttctgttcgagagatcgggccacttggtcagtggctggttttgactactggggccggggaacctggtcaccgtctcctcagctccaccaagggccatcggtcttcccctggcgccctgctccaggagcacctctcgaggcacagcgccctggctgcctggtcaagactacttcctatatactgtctgagcggggctggcaaggcgcataa

SEQ ID NO: 794563 - DNA, 620 bp, Homo sapiens
  misc_feature: 80714.44.23.C01.1.pb.heavy.1.raw 80714
ctatgcgccttgccagcccgctcagacagtatataggaaactagtccttgaccaggcagcccagggccgctgtgcccccagaggtgctcctggagcagggcgccagggggaagaccgatgggcccttggtggaagctgaggagacagtgaccagggtgccacggcccatagattgaaagaccagtctcgcctcgcacagaaataaacggccgtgtccgcggcggtcacggaggtcagtttcaggagaaagcggttcatggacgtgtccctcgaaatggtgagacgactcttgagggacggagagtagtacgtcgccccagtataatggatgtcaccaatcactccattccccctccctggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaaccacaggtgttcaccctgccccaatccctaatcacgtgtactaaatcgagcaccggtcgtgtatatactgtctgatggcgcgaggaggcgatacg

SEQ ID NO: 794564 - DNA, 454 bp, Homo sapiens
  misc_feature: 80727.44.46.E02.1.pb.heavy.1.raw 80727
ctatgcgccttgccagcccgctcagacagtatataggaagtagtccttgaccaggcagccccagggccgctgtgccccagaggtgctcttgggaggagggtgccagggggaagacgatgggcccttggtggaggctgaggagacggtgaccagggttccctgggccccaggggtcgagccagttcggcccccccgtctctactgtatcgataggaatctctcgcacaataatatacggccgtgtccgcggcggtcacagaagtcaatttcagggagaactggttcttggacctggtctagtgacatggtgactcgactcttgaggcggggttgtagttggtgctgccactgttatagatgcgcccaatccactccagtccctttccctgtagatgagtctaaatcgagcaccggtcgtgtatatactgtctgatggcgcgagggaggcgatacg

SEQ ID NO: 794565 - DNA, 703 bp, Homo sapiens
  misc_feature: 80729.44.55.E11.1.pb.heavy.1.raw 80729
ctatgcgccttgccagcccgctcagacagtatataggaagtagtccttgaccaggcagcccagggccgctgtgcccccagaggtgctcttggaggagggtgccagggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggagtctgcgtagtatgtgaaatcaccagtataaatgactgagaccccactccagccccttccctggagcctggcggacccaactcatgtagttgctgctgacggtgagcccagaggctgcacaggagagtctctgggacccccaggctggactaagcctcctccagactccatcagccgcacctcacactggacaccttttaaaagtccaacaaggagaacccagctcagccaaaactccatggtgagtcctctgtgttcagtgctgatcaccgaatggaaacacctcggaatcccagtgctgggctcctctccccaaacccaacgtgcgagtgctaaatcgagcaccggtcgtgtatatactgtctgatggcgcgagggaggcgatacg

SEQ ID NO: 794566 - DNA, 720 bp, Homo sapiens
  misc_feature: 80733.UNK.UNK.UNK.pb.heavy.1.raw 80733
cgtatcgcctccctcgcgccatcagacagtatatacacggaccggtgctcgatttagagtatacatattgggtttgggggggaggaggagcccagcactggattccgaggtgtttccattcggtgatcagcaactgaacacagaggactcaccatggagttttggcttgagctgggttctccttgttggacttttaaaaggtgtccagtgtgaggtgcggctgatggagtctggaggaggcttaggtccagcctggggggtcccagagactctcctgtgcagcctctggggctcaccgtcagcagcaaactacatgagttgggtccgccaggctccagggaaggggctggagtggtcctcagtcatttatactggtgattttcacatactacgcagactccgtgaagggcccgattcaccatcctccagggacaattccaggaacacgtttttatcttcaaatgaaccaacctgagaggcgacgacacgggccgtctattactgtgcgagacaagtcggcgctcggaagtggttatattcgtttgacttctggggccagggaaccctggtcaccggtcgcctccgcctccaccaagggccatcggtctccctggcaaccctcctccaagagccacctctgggggcacagcggccctgggctggcctggtcaaggactacttcctatatactgtttgagcgggctggcaaaggcgccatag

SEQ ID NO: 794567 - DNA, 701 bp, Homo sapiens
  misc_feature: 80754.44.27.C05.1.pb.heavy.1.raw 80754
ctatgcgccttgccagcccgctcagacagtatataggaagtagtccttgaccaggcagcccagggccgctgtgctctcggaggtgctcctggagcagggcgccaggggaagaccgatggcccttggtggaggccgaggagacggtgaccagggttccctggccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctggcggacccactgcatattccaattatcgaaggtgaatccagaggctgcacaggagagtctcagggacccccctactggggccacgcctcccccagactcacgaattgcacctgacacatgacacctcttaagagggcaacgaggaaaacccagctcagcccaaactccatggtgagtcctctgtgttcagtgatgatcaccgagtgaaacaccggcgacttccagtgctgggctcgtctcccaggcccccaaacccttcgatcgcgtctaaatcgagcaccggtcgtgtatatactgtctgatggcgcgaggaggcgatacg

SEQ ID NO: 794568 - DNA, 680 bp, Homo sapiens
  misc_feature: 80765.44.45.E01.1.pb.heavy.1.raw 80765
cgtatcgcctccctcgcgccatcagacagtatatacacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactgggccagggagccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794569 - DNA, 703 bp, Homo sapiens
  misc_feature: 80787.44.55.E11.1.pb.heavy.1.raw 80787
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctgggccagggaaccctggtcaccgtcgcctccgcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794570 - DNA, 660 bp, Homo sapiens
  misc_feature: 80810.UNK.UNK.UNK.pb.heavy.1.raw 80810
ctatgcgccttgccagcccgctcagacagtatataggaagtagtccttgaccaggcagccagggccgctgtgcccccagaaggtgctcctggagcagggcgccagggggaagaccgatggcccttggtggaagctgaggagacagtgaccagggtgccacggcccccatagatttgaaagaccagtctcgcctcgcacagaaataaacgggccgtgtccgcggcggtcacggaggtcagtttcagggagaagcggttcatggacgtgtccctcgaaatggtgagacgactcttgagggacggagagtagtacgcgtcgccccagtataatggatgtcaccaatccactccattcccctccctgggggctgccggatccagccccaagaatgatcagaactgatggaaactccagagacagtgcagatgagagacagggttccccgaaggcctcaccagtcctgggccgccgactcctgcagctgcacctgggacaggacccatctgggagcctgccaccagcaggaggaaaacagcaaggtgccttcatgttcttgcacaggaggtcctgactctcagaaagccccaatccctaatcacgtgtactaaatcgaggcacggtcgtgtatatactgtctgatggcgcgagggaggcgatacg

SEQ ID NO: 794571 - DNA, 699 bp, Homo sapiens
  misc_feature: 80829.44.70.G04.1.pb.heavy.1.raw 80829
cgtatcgcctccctcgcgccatcagacagtatatacacgaccggtgctcgatttagtgtagtgtgaagggaaaggggtctgggagaggagcccagcactagaagtcggcggtgtttccattcgtgatcagcactgacacagaggactcaccatggagtttggctgagctgggtttcctcgttgctcttttaagaggtgtccactgtcaggtgcacctggtggagtctggggaggcgtggtccagcctgggaggtccctgagactctcctgtgaagcctctggatttagtttcagtggttctggcatgcactgggtccgccaggctccagcaagggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttccccctggcgccctgctccaggagcacctccgagagcacagcggcctgggctgcctggtcaaggactacttcctatatactgtctgagcggctggcaaggcgcatag

SEQ ID NO: 794572 - DNA, 628 bp, Homo sapiens
  misc_feature: 80848.UNK.UNK.UNK.pb.heavy.1.raw 80848
gaagggctggcaggctatgcaccctggtccagggtcaaaaagctgcccgaacccgctaagcgggccatctttgggccacctaggggttcccgcgaattcgatattgttcccgtcttagcatggcacaatgctgtgcaaaacccagcttgcaatgccacagcaaagcggccaatctttatacgcccacgttgaattgtttattacctgtgactggctatggcttgcaaacgccactcgtaaaactagtactttgcggttagggaaagtagacaaaccattactccacttcccgaaagttcactcattccaacacgaaataaaagtaaactcaacacccaagcaggctatgtgggggggtgataggggggattctatttcctatcccatcccctaggatctcaattaagttactagcgagttaaatgtctgtagcgatccccgtcagtcctatcgcgcgcatcaagacctggttggttgagcgtgcagtagatcatcgataagctgcgaagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794573 - DNA, 705 bp, Homo sapiens
  misc_feature: 80854.44.55.E11.1.pb.heavy.1.raw 80854
cgtatcgcctccctcgcgccatcagacagtatatacacgaccggtgctcgatttagcactcgcacgttgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttgggtccgccaggctccagggaaggggctggagtgggtctcagtcatttatactggtgatttcaacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctcaagagcacctctggggcacagcggccctggggctgcctggtcaaggactactttcctatatactgtctgagcgggctggcaaggcgcatag

SEQ ID NO: 794574 - DNA, 637 bp, Homo sapiens
  misc_feature: 80857.44.6.A06.1.pb.heavy.1.raw 80857
cgtatcgcctcctcgcgccatcagacagtatatacacgaccggtgctcgatttagatctactgacaaccacatcctctctaaagaagcccctgggagccacgcatcaccatggactgacctggaggtcctctttgtgtggcagcagcaacaggtgtccagtccctgggcaactgtgcagtctgggactagaatgccgcacttgggtcctcgtgaccctttcctgcacgcctctgaagtactaccagttccactactatacatcaactgggtgcgccaggcctggacaagggcttgagtgatgggtgaatcatccctctttttggctcactcacctacgcacgagacttccggggcaaattacgattacgcgacaagtcacagacacagtctccatgacaatgagttcttgaaatcgacgacacgccgtctactactgtgcgagaggtccgtaacccagcgcatggagcctttgagatctggggcagggaaccctggtcattgtcacctcagcttccaccaagggcccatcgtctcccctggcgccctgctccaggagcacctctgggggcacagcggcctgggctgcctggtcaaggactacttcctatatactgtctggcggctgcaaggcgcata

SEQ ID NO: 794575 - DNA, 607 bp, Homo sapiens
  misc_feature: 80862.44.36.D03.1.pb.heavy.1.raw 80862
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacggtgaccgtggtccctttgccccagacgtccagatggtaagacttataatacagaaaccagctgtttctttcccgcattacccgtgcacagtaatatgtgcctgtgtccgcagggtccatgttggtcatactaaagaccacctgccttttggaggtgtccttggagatggttaaactgctcttcagagatgtactgtaggatttttcgtcattcgagaagatgtgtgcaagccactccagggccttccctgggggctgacggatccagctcacacccattctaatatcgttgagagagaacccagagatggtgcaggtcagcgtgagggtctctgtgggtttcaccagcacaggaccagactccttcaaggtgacctgggacaagacccaagagagatcgtgacgcagctaaatcgagcaccggtcgtgtatatactgctgatggcgcgagggaggcgatacg

SEQ ID NO: 794576 - DNA, 588 bp, Homo sapiens
  misc_feature: 80873.44.78.H01.1.pb.heavy.1.raw 80873
cgtatcgcctccctcgcgccatcagacagtatatacacgaccggtgctcgattagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctcccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794577 - DNA, 670 bp, Homo sapiens
  misc_feature: 80883.44.71.G05.1.pb.heavy.1.raw 80883
cgtatcgcctccctcgcgccatcagacagtatatacacgaccggtgctcgatttagtgtcgtcgcaagagagaggggccagccctggggactgaacagagagaactcaccatggagtttgggctgagctggctttttcttgtggctgttttaaaaggtgtccagtgtgaagtgcagctgttggagtcgggggaggcttggtacagccggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctgggcaaagggaccccggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatag

SEQ ID NO: 794578 - DNA, 658 bp, Homo sapiens
  misc_feature: 80902.44.71.G05.1.pb.heavy.1.raw 80902
ctatgcgccttgccagccgctcagacagtatataggaagtagtccttgaccaggcagcccaggcgctgtgcccagaggtgctcttggaggagggtgccagggggaagaccgatggcccttggtggaggctgaggagacggtgaccggggtccctttgcccagacgtccatgtagtagtaatacttgtattgttgtaacttctgcgaccctctggcacagtaataaagggccgtgtcgtccactcgcaggctcttcatctgcagaaacaccgtattcttggaattgtccctggagacgatgaagcggcccttcacggagtctgcgacatttgtggcactacaccagtaatggatgagaccactccagcccttccctgggcctgacggacccagatcatggcataggtattaaaggcgaatcagaggctgcacaggagagtgtcaggaccccccggctgtaccaagcctccccccgactccaacagctgcacttcacactggacaccttttaaaacagccacaagaaaaagccagctcagcccaaactccatggtgagttctctctgttcagtcccaggctggctcctctctcttgcgacgacactaaatcgagcaccggtcgtgtatatactgtctgatggcgcgagggaggcgatacg

SEQ ID NO: 794579 - DNA, 620 bp, Homo sapiens
  misc_feature: 80908.UNK.UNK.UNK.pb.heavy.1.raw 80908
cgtatcgcctccctcgcgccatcagacagtatatacacgaccggtgctcgatttagttacacgtgattagggattgggcagggtgtgaacacctgtgtttttcctcctgctggtggcagctccagaatgggtcctgtcccaggtgcagctgcaggagtcgggccaggacctggtaggccttcgggaaacctgtctctcatctgcactgtctctggagtgttccatcagttcctgatcattctttgggctggatccggcagccccagggaggggaatggagtggattggtgacatccattatactggggggacgtactactcccgtccctcaagagtcgtctcaccatttcgaggacacgtccatgaaccgcttctccctgaaaactgacctccgtgacgccgcggacacggccgtttatttctgtgcgaggccgagactggtctttcaatctatgggccgtggcaccctggtcactgtctcctcagcttccaccaagggcccatcggtcttccccctggcgccctgctccaggagcacctctgggggcacagcggccctgggctggcctggtcaaggactacttcctatatactgtctgagcgggctgcaaggcgcatag

SEQ ID NO: 794580 - DNA, 713 bp, Homo sapiens
  misc_feature: 80916.UNK.UNK.UNK.pb.heavy.1.raw 80916
cgtatcgcctccctcgcgccatcagacagtataatacacgaaccggtgctcgatttagcactcgcacgttggggtttggggagaggagcccagcactgggattccgaggtgtttccattcggtgatcagcactgaacacagaggactcaccatggagttttggctgagctgggttctccttgttggacttttaaaaggtgtccagtgtggaggtggcggctgatggagtctggaggaggcttagtccagcctggggggtcccagagactctcctgtgcagcctctgggctcaccgtcagcagcaactacatgagttgggtccgccaggctccagggaagggggctggagtggggtctcagtcatttatactgcgtgatttcacatactacgcagactccgtgaagggccgattcaccatctccagggacaattccaggaacacggtttatcttcaaatgaacaacctgagaggcgacgacacggccgtctattactgtgcgagacaagtcggccggctcggagtggttattattcgtttgacttctggggccagggaaccctggtcaccgtcgcctccgcctccaccaagggcccatcggtctttccccctggcaccctcctccaagagcacctctgggggcacagcggccctgggctgcctggtcaaggactacttcctatatacgtctgagcgggctggcaaggcgcatag

SEQ ID NO: 794581 - DNA, 605 bp, Homo sapiens
  misc_feature: 80935.UNK.UNK.UNK.pb.heavy.1.raw 80935
gaaggctgggcaggctatgcaccctggtccaggtcaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttagggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794582 - DNA, 619 bp, Homo sapiens
  misc_feature: 80937.UNK.UNK.UNK.pb.heavy.1.raw 80937
cgtatcgcctcccctcgcgccatcagacagtatatacacgaccggtgctcgatttagctgcgtccacgatctctcttgggtcttgtcccaggtcacccttgaaggagtctggtcctgtgcttggtgaaacccacagagaccctcacgctgacctgcaccattctctgggttctctctcaacgatattagaaatgggtgtgagctggatccgtcagcccccaggggaaggcccttggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaaagaaacagctggtttctgtattataagtcttaccatctggacgtctgggggcaaagggaccacggtcaccgtctcctcagcttccaccaagggcccatcggtcttcccccctggcgcctgctccaggagcacctctgggggcacagcggccctggggctgcctggtcaaggactacttcctatatactgtctgagcgggctggcaaggcgcatag

SEQ ID NO: 794583 - DNA, 698 bp, Homo sapiens
  misc_feature: 80956.UNK.UNK.UNK.pb.heavy.1.raw 80956
cgtatcgcctccctcgcgccatcagacagtatatacacgaccggtgtgctcgatttagtgagtcagtaagggaaagggggctgggagaggagcccagcactagaagtcggcggttgtttccattcgggtgatcagcactgaacacagaggactcaccatggagtttgggctgagctgggtttttcctcgttgctcttttaaagaggtgtccagtgtcaggttcagctggtggagtctgggggaggcgtggtccagcctgggacgtccctgagactctcctgtgtttgcgtccggactcagtttcagtgactctgccatgcactgggtccgccaggctccaggcaaggggctggagtgggtggcagtcatctggtctgatggaagtaaagaatactatggaaaactccgtgaagggcccgattcttccgtctccagagacaattccaagaacaccgtgtatctacaaatgaacaatttgagagccgaggactcggctctctattattgtacgagcccatcgttctactggggccagggagccctggtccaccgtctcctcagcctccaccaagggcccatcggtctttccccctggcgccctgctccaggaagcacctccgagagcacagcggccctgggctgcctggtcaaggaactacttcctatatactgtctgagcgggctggcaaggcgcatag

SEQ ID NO: 794584 - DNA, 704 bp, Homo sapiens
  misc_feature: 80963.44.36.D03.1.pb.heavy.1.raw 80963
cgtatcgcctccctcccgcgccatcagacagtatatacacgaccggtgctcgatttagctgcgtcacgatctctcttgggggagaagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggaggtggcttggccgcagtaaaaacaaagttgccagctttatcacagagtacgccgcgttctgtgaaagccagattcaccctcttcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 794585 - DNA, 679 bp, Homo sapiens
  misc_feature: 80964.UNK.UNK.UNK.pb.heavy.1.raw 80964
cgtatcgcctccctcgccgccatcagacagtatatacccacgaccgggtgctcgatttagtgtcgtcgcaagagagaggggccccagccctgggactgaacagagagaactcacccatggagttgggcgagctggcttttcttgtggctgttttaaaaggtgtccagtgtgaagttgcagctgttggagtcggggggaggcttgggacagccggggggggtccctgacactctctgtgcagcctctggattcgccttaatacctatgccatgatctgggtccgtcagccccagggaaggggctggagtgggtcccatccatactggggtagtgccacaaatgtcgcagactcgtgaagggccggcttcatcgtctccagggacaattccaagaatacgggtgtttctgcagatgaagagcctgcgagtggacgacacggccctttattactgtgccagagggtcgcagaagttacaacaatacaagtattactactacatggacgtctggggcaaagggaccccggtccaccgtctccccagcctccaccaagggcccatcggtcttccccctggcacccctcctccagaggcacctctgggggcacagcggccctggggctgcctggtcaaggactacttccatatactgtctgagcggggctggcaaggcggcatag

SEQ ID NO: 794586 - DNA, 602 bp, Homo sapiens
  misc_feature: 80965.UNK.UNK.UNK.pb.heavy.1.raw 80965
gaaggctggcaggctatgcaccctggtccaggtcaaaagctgcggaacccgctagcggccatcttggccactaggggtcccgcagattcatattgtcgtctagcatgcacaatgctgcaacccagcttgcaatgcccacagcaagcggccaatcttacgccacgttgaattgtttattacctgtgactggctatggctttgcaacgccactcgtaaaactagtactttgcggttaggggaagtagacaacccattactcacttcccggaagttcactcattccaacacgaaataaaagtaaactcaacaccccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagcgtgcagtagatcatcgataagctgcgagttaggtcatcccagaccgcatctggcgcctaaacgttcagtggtagctaagcgtcaccttcgactgtctaaaggcaatatgtcgtccttagctccaagtccctagcaagcgtgtcggg

SEQ ID NO: 794587 - DNA, 687 bp, Homo sapiens
  misc_feature: 80978.44.45.E01.1.pb.heavy.1.raw 80978
ctatgcgccttgccagcccgctcagacagtatatagggaagtagtcctttgacccaggcagcccagggccgctggttgctctcggaggtgctcctggagcagggcgccagggggaagaccgatggcccttggtggaggctgaggagacggtgaccagggctccctggccccagtagaacgatgggctcgtaacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgctggagcctggcggacccagtgcaatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtctctgtgttcagtgctgatcaccgaatggaaacaccgccgacttctagtgctgggctcctctcccagcccctttcccttactgactcactaaatcgagcaccggtcgtggtatatactgtctgatggcgcgaggaggcgatacg

SEQ ID NO: 794588 - DNA, 679 bp, Homo sapiens
  misc_feature: 80988.UNK.UNK.UNK.pb.heavy.1.raw 80988
ctatgcgccttgccagcccgctcagacagtatataggaagtagtccttgaccaggcagccagggccgctgtgccccagaggtgctcctggagcagggcgccagggggaagaccgatgggcccttggtggaagctgaagagacggtgaccattgtcccctggccccaatatcaaatgcatcgacgtcccaggatcgcctggcgcagtaatagacgctgtgtcgtcgggtctcaggttgctcatttgtaaatggccacactgttggagtcatccttgagacggtgaatcttccttcacagacgcgggtactctttacttccaccataacgttcattctgacgaaagtgatccactcaagccccttccctggagctgacggacccaggccaagtgataatcactaagactgaatcctgagactacacaggagagtctcagagaccgccctggctgtgccaagcccccccccgactccgccagtcgcctcgcactggacacctctaaaaaaacacaaggaaaatcaagattagccaaactccatggttggtggtctgtgctcagtgctgatcaccagtggaactcctgggaatctcacggctggggctccttctctctgcgacgacactaaatcgagcaccggttcgtgtatatctgtctgatggcgcgagggaggcgatacg

SEQ ID NO: 794589 - DNA, 659 bp, Homo sapiens
  misc_feature: 80993.44.23.C01.1.pb.heavy.1.raw 80993
ctatgcgccttgccagcccgctcagacagtatataggaagtagtccttgaccaggcagcccagggccgctgtgccaccagaggtgctcctggagcagggcgccagggggaagaccgatgggcccttgtggaagctgaggagacagtgaccagggtgccacggccccatagatttgaaagaccagtctcgcctcgcacagaaataaacggccgtgtccgcgcggtcacggaggtcagtttcaggaagaagctggttcatggacgtgtccctcgaaatggtgagacgactcttgagggacggagagtagtacgtcgccccccagtataatggatgtcaccaatccactccattccccctccctgggggctgccggatccagccccaagaatgatcagaactgatggaaactccagagacagtgcagatgagagacagggttcccgaaggcctcaaccagtcctgggcccgactcctgcagctgcacctgggacaggacccatctgggagctgccaccagcaggagggaaaaaccacaggtgcttcatgttcttgcacaggaggtccttgactctcagaaagcccccaatccctaatcacgtgtactaaaatcgagcaccggtcgtgtatatactgtctgatggcgcgagggaggcgatacg

SEQ ID NO: 794590 - DNA, 700 bp, Homo sapiens
  misc_feature: 80994.44.27.C05.1.pb.heavy.1.raw 80994
cgtatcgcctccctcgcgccatcagacagtatatacacgaccggtgctcgatttagacgcgatcgaaggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggccgtggccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggcgtgtatttttgtgcgagactatctgtttccaaaatcggttcattcgacgcctggggccagggaaccctggtcaccgtctcctcggcctccaccaagggccatcggtcttcccctggcgccctgctccaggagcacctccgagagcacagcggccctgggctgcctggtcaggactacttcctatatactgtctgagcgggctggcaaggcgcatag

SEQ ID NO: 794591 - DNA, 678 bp, Homo sapiens
  misc_feature: 80996.44.53.E09.1.pb.heavy.1.raw 80996
cgtatcgcctcctcgcgcatcaggacagtatatacacgaccggtgctcgatttagagagagtgtgttgagctctggagaggagccccagccttgggattcccaggtgttttcattcagtgatcaggactgaacacagaggactcaccatggagtttgggctgagctggattttccttgctgctattttaaaaggtgtccagtgtgaggtgcagttgtgggagtctggggaggtttggtaaagcctggggagtccttagactctcctgtgcaggcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaacctggtcaccgtctcctcagcctccaccaagggcccatcggtcttccccctggcgccctgctccaggagcacctccgagagcacagcggccctggctgcctggtcaaaggactacttcctatatactatctgagcgggctggcaggcgcatag

SEQ ID NO: 794592 - DNA, 704 bp, Homo sapiens; identical to SEQ ID NO: 792531
  misc_feature: 81006.44.73.G07.1.pb.heavy.1.raw 81006

SEQ ID NO: 794593 - DNA, 710 bp, Homo sapiens
  misc_feature: 81014.44.55.E11.1.pb.heavy.1.raw 81014
ctatgcgccttgccagcccgctcagacagtatataggaagtagtccttgaccaggcagcccagggccgctgtgccccagaggtgctcttggaggagggtgccaggggaagaccgatgggcccttggtggaggcggaggcgacggtgaccagggttccctggccccagaagtcaaacgaataataaccactccgagcgccgacttgtctcgcacagtaatagacggccgtgtcgtcgcctctcaggtttgttcatttgaagataaaccgtgttccttggaattgtccctggagatggtgaatcggcccttcacggagtctgcgtagtatgtgaaatcaccagtaataaatgactgagaacccactccagccccttccctggagcctggcggacccaactcatgtagttgctgctgacggtgagcccagaggctgcacaggagagtctctgggacccccaggctggactaagcctcctccagactccatcagccgcacctcacacctggacaccttttaaaaagtccaacaaggagaacccagctcagccaaaactccatggtgagtcctctgtgttcagtgctgatcaccgaatggaaacacctcggaatccagtgctgggctcctctcccccccaaacccaacgtgcgagtgctaaatcgagcaccggtcgtgttatatactgtctgatggcggcgagggaggcgatacg

SEQ ID NO: 794594 - DNA, 709 bp, Homo sapiens
  misc_feature: 81026.UNK.UNK.UNK.pb.heavy.1.raw 81026
cgtatcgcctccctcgcgccatcagacagtatatacacgaccgggtgctcgatttagtagctctatcagggggagcatcacataacaaccacattcctcctctaaagaagcccctgggagcacagctcatcaccatggactggacctggaggttcctctttgtggtggcagcagcaacaggtgtccagtcccctggtgcaactggtgccagtctgggactagaatgccgcaaccttggtcctccggtgaccctttcctgcacggctctggaagtactaccagttccactacttataccatcaactgggtgcgccaggccccctggaccaagggcttgagtggatgggtggaatcatccctctttttggctcactcacctacggcacgagacttccggggcagaattacgattaccgcggacaagtccacagacacgagtctcccatgacaatgagttctttgaaatccgacgacacggccgtctactactgtgcgagaggctcgcgtacccccagctcgcatggagcctttgagatctggggggcagggaaccccctgggtcattgtcacccctcagcttccaccaagggcccatcggtcttccccctggcgccctgctccaggagcacctctggggcacagcgccctggctgcctggtcaaggactacttcctatatactgtctggagcgggctggcaaggcgcatag

SEQ ID NO: 794595 - DNA, 645 bp, Homo sapiens
  misc_feature: 81049.44.19.B08.1.pb.heavy.1.raw 81049
ctatgcgccttgccagcccgctcagacagtatataggaagtagtccttgaccaggcagcccagggccgctgtgctctcggaggtgctcctgagcagggcgccagggggaagaccgatgggcccttggtggaggctgatgagacggtgacctggattccctggccccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggcctttccggggggctgccgcacccagacaacgccctctccaggagtgacgagtgagaagcctgagacggtgcaggtcagcgtgagggtctgtgtgggtttcaccaatgtagggccagactctttcacggtgatctgggacaggccccatgaagggatggtcagcagcaggagcgtggagcaaagtgtgtccatggtggggcacaggagtcccccttactgactcactaaatcgagcaccggtcgtgtatatactgtctgatggcgcgagggaggcgatacg

SEQ ID NO: 794596 - DNA, 675 bp, Homo sapiens
  misc_feature: 81053.44.35.D02.1.pb.heavy.1.raw 81053
ctatgcgcccttgccagcccgctcagacagtatatagaagtagtccttgaccaggcagcccagggccgctgtgcccccagaggtgctcttggaggaggtgccagggggaagaccgatgggccttggtggaggctgaggagacggtgaccagggttccctggccccagggtcgagccagttcgcccccccgtctctactgtatcgataggaatctctcgcacaataatataacggccgtgtcgcggcggtcacagaagtcaatttcagggagaactggttcttggacctgtctagtgacatggtgactcgactcttgagggcgggttgtagttggtgctgccactgtttatagatgcgccaatccactccagtcccttcccggcggactgccgcagccaactccaataataactactgatgtaaccaccagagacattgcaggtgagggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgagcaccggtcgtgtatatactgtctgatggcgcgagggaggcgatacg

SEQ ID NO: 794597 - DNA, 712 bp, Homo sapiens
  misc_feature: 81055.UNK.UNK.UNK.pb.heavy.1.raw 81055
ctatgcgccttgccagcccgctcagagcagtatataggaagtagtcttgaccaggcagcccagggccgctgtgcccccagaggtgctctggaggagggtgccagggggaagaccgatgggcccttgggtggaggcggaggcgacggtgaccagggttccctggccccagaagtcaaacgaataataaccactccgagcgccgacttgtctcgcacagtaatagacggccgtgtcgtcgcctctcaggttgttcatttgaagataaaccgtgttcctggaattgtccctggagatggtgaatcggcccttcacggaggtcctgcgtagtatgtgaaatcaccagtataaatgactgagacccactccagccccttccctggagcctggcggacccaactcatgtagttgctgctgaccggtgagccccagaggctgcacaggagagtctctgggaccccccaggctggactaagcctcctccagactccatcagccgcacctcacactggacaccttttaaaagtccaacaaggagaacccagctcagcaaaactccatggtgagtcctctgtgttcagtgctgatcaccgaatggaaacacctcggaatcccagtgctgggctcctctcccccccaaacccaacgtgcgagtgctaaatcgagcaccggtcggtggtatatactggtctgatggcgcgagggaggcgatacg

SEQ ID NO: 794598 - DNA, 699 bp, Homo sapiens
  misc_feature: 81058.44.36.D03.1.pb.heavy.1.raw 81058
cgtatcgcctccctcgcgccatcagacagtatatacacgaccggtgctcgatttagctgcgtcacgatctctcttggggagctctgagagcggagccccagccccagaattcccaggtgttttcattggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgcaggctccagggaaggggctggagtggcttggccgcagtaaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttcccctggcgccctgctccaggagcacctccgagagcacagcggccctggctgcctggtcaaggactacttcctatatactgtctgagcgggctggcaaggcgcatag

SEQ ID NO: 794599 - DNA, 650 bp, Homo sapiens
  misc_feature: 81065.44.23.C01.1.pb.heavy.1.raw 81065
ctatgcgccttgccagcccgctcagacagtatataggaagtagtccttgaccaggcagcccaggccgctgtgcccccagaggtgctcctggagcagggcgccagggggaagacgatgggccccttggtggaagctgaggagacagtgaccagggtgccacggccccatagattgaaagaccagtctcgctcgcacagaaataaacggccgtgtccgcggcggtcacggaggtcagtttcagggagaagcggttcatgacgtgtccctcgaaatggtgagacgactcttgagggacggagagtagtacgtcgccccagtataatggatgtcaccaatccactccattcccctccctgggggggctgccggatccagccccaagaatgatcagaactgatggaaactccagagacagtgcagatgagagacagggttcccggaaggcctcaccagtcctggcccgactcctgcagctgcacctggacaggacccatctggagctgccaccagcaggaggaaaaaccacaggtgggcttcatgttcttgcacaggaggtccttgactctcagaaaggccccaatccctaatcacgtgtactaatcgagcaccggtcgtgtatatactgtctgatgcgcgagggaggcgatacg

SEQ ID NO: 794600 - DNA, 645 bp, Homo sapiens
  misc_feature: 81070.44.19.B08.1.pb.heavy.1.raw 81070
ctatgcgccttgccagcccgctcagacagtatataggaagtagtccttgacccaggcagcccaggccgctgtgctctcggaggtgctcctggaagcagggcgccaggggaagaccgatgggcccttggtggaggctgatgagacggtgacctggattccctggcccagggttcgaagaagcccgtggtcattgtggtcatgaagtgggcacagaaatatgtgcctgtgtccacagggtccacgttggtcaatgtaaggaccacctggtttttggacgtgtccttcgtgagcgtgagtctggtcgtcagagaaggactatatcgtatatcgtcattccaataagtgagtgcgatccactccagggccttttccgggggctgccgcacccagacaacgccctctccaggagtgacgagtgagaagcctgagacggtgcaggtcagcgtgagggtctgtgtgggtttcaccaatgtagggccagactcttttcacggtgatctgggacaggccccatgaagggatggtcagcagcaggagcgtggagcaaagtgtgtccatggtggggcacaggagtcccccttactgactcactaatcgagcaccggtcgtgtatatactgtctgatggcgcgagggaggcgatacg

SEQ ID NO: 794601 - DNA, 553 bp, Homo sapiens
  misc_feature: 81072.UNK.UNK.UNK.pb.heavy.1.raw 81072
cacgcttgcagggacttggagctaagacgacatattgctttagaagtcgagtgacgctagctacactgaacttagcgcgatgggtctggatgacctaactcgcgcttatcgatgattactgcacgccaaccaacaggtcttgatgcgcgcgataggactgcgatcgctacagacatttaactcgctagtaacttaattgagatctaggggatggataggaaatagaatccacccctatcaccacatagccgcttgggtgttgagtttacttttattcgtgttggaatgagttgaactccggaagtggagtaatggttgtctacttcccctaacgcaaagtactagttttacgagtgcgttgcaagccatagccagtccacaggtaataaaacaattcaacgtggccgtaaagattggcgcttgctgtggcattgcaagctggtttgcagcattgtgcatgctagacgacaatatgaatctgcggaccctagtgcagatggccgctagcggttcgcagctttgacctggaccaggtgcatagcctgccagcttc

SEQ ID NO: 794602 - DNA, 579 bp, Homo sapiens
  misc_feature: 81078.44.78.H01.1.pb.heavy.1.raw 81078
cgtatcgcctccctcggcgccatcagacagtatatacacgaccggtgctcgatttagtgtgagtagttttgggtttgggtgccgaagttgctggaggtcacggtcaccacgctgctgaggtgaagaagccctggggcctcagtgacagtctcctgcacggcttctggatacacgttcattcaattatgattattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtgggcccagggaaccctggttcaccgtctcctcagcctccaccaagggcccatcgtcttccccctgggcgccctgctccaggagcacctccgagagcacagcggccctggggctgcctgtcaaggactacttcctatatactgtctgagcgggctggcaaggcgcatag

SEQ ID NO: 794603 - DNA, 678 bp, Homo sapiens
  misc_feature: 81082.UNK.UNK.UNK.pb.heavy.1.raw 81082
cgtatcgcctccctcgcgccatcagacagtatatacacgaccggtgctcgatttagcactcgccgttggtttggggagaggagcccagcactgggattccgagtgttttccattcggtgatcagcactgaacacagaggactcaccatggagttttggctgagctgggttctccttgttggactttaaaggtgcagtgtgaggtgcggctgatggagtctggaggaggcttagtccagcctgggggtcccagagactctcctgtgcagcctctgggctcaccgtcagcagcaactacatgagttgggtccgccaggctccagggaagggctggagtgggtctcagtcatttatactgtgatttcacatactacgcagactccgtgaagggccgatcaccatctccagggacattccaggaacacggtttatcttcaatgaacaacctgagaggcgacgacacgccgtctattactgtgcgagacaagtcggcgctcgggtggttattatcgttgacttctgggcagggaaccctggtcaccgtcgcctcgcctccaccaagggccatcggtcttcccctggcacccctcctcaagagcacctctggggcacagcggccctggctgcctggtaaggactacttcctatatactgtctgagcggctggcaaggcgcatag

SEQ ID NO: 794604 - DNA, 710 bp, Homo sapiens
  misc_feature: 81085.UNK.UNK.UNK.pb.heavy.1.raw 81085
ctatgccgccttgccagcccgctcagacagtatataggaagtagtccttgaccaggcagccaggccgctgtgctctcggaggtgctcctggagcaggcgccaggcgaagacgatggcccttggtggaggcctgaggagacggtgacagggttccctggccccagtggacagttcctgatataaacacaacacaataatacatgccgtgtcctcggttccaggttaccgtcattcgcagaatcatagtctttgagtcatcttttgagaggcgtgaatctggctttccacagaccgcggccgctactctgtgataaagctggcaactttgtttttactgcggccaagccactccaggcccgcttcctggagcctgcggaccccagtccatatcagtggggtcactgatggtgaatccagaggcggacaccaggagagtctcagggaccctccagggctggaccaagtctcccccggactccaccactgcacttcactctggacacttgtaaagataacaacaagggaaaacccagctcagcccgaactccatggtgagtcctctgtgtttcagtgctgatcaccaatgaaaacacctgggaattcggggctggggctccgctctcagagctccccaagagagatcgtacgcagctaaatcgagcaccggtccgtggtatatacgtgtctgatggccgcgaggaggcgatacg

SEQ ID NO: 794605 - DNA, 730 bp, Homo sapiens
  misc_feature: 81097.44.33.C11.1.pb.heavy.1.raw 81097
ctatgcgccttgccagcccgctcagacagtatataggaagtagtccttgaccaggcagcccagggccgctgtgccccagaggtgctcttggaggagggtgccagggggaagaccgatgggccctggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctggggctcctctcccagagctccccaaacccaacgagctcactctaaatcgagcaccggtcgtgtatatactgtctgatggcgcggagggaggcgatacg

SEQ ID NO: 794606 - DNA, 698 bp, Homo sapiens
  misc_feature: 81108.44.27.C05.1.pb.heavy.1.raw 81108
cgtatcgcctccctcgcgccatcagacagtatatacacgaccggtgctcgatttagacgcgatcgaagggtttggggctgggagacgagcccagcactggagtcgccggtgtttccactcggtgatcatcactgaacacagaggactcaccatggagtttgggctgagctgggttttcctcgttgccctcttaagaggtgtcatgtgtcaggtgcaattcgtggagtctgggaggcgtggccccagtagggggtccctgagactctcctgtgcagcctctggattcacttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcggggctggcaaggcgcatag

SEQ ID NO: 794607 - DNA, 717 bp, Homo sapiens
  misc_feature: 81118.UNK.UNK.UNK.pb.heavy.1.raw 81118
ctatgcgccttgccagcccgctcagacagtatataggaagtagtccttgacaggcagcccagggccgctgtgggcctctcggaggtgctcctggagcaggggcgccagggggaagaccgatgggcccttggtggaggccgaggagacggtgacagggttccctggcccaggcgtcgaatgaaccgatttggaaaacagatagtctcgcacaaaaatacacggcggccgtgtcctgaggtctcaggctgttcatttgaagaggacactgtgtctcgaattgtctctggagatggtgaatcggccctcaacggaatcaccgtagacttgatttcctccatgaaatgacacacctgccacccactccaggcccctcggcctggagcctggcggacccactgcatattccaattatcgaaggtgaatccagaggctgcacaggagagtctcagggacccccctactggggccacgcctcccccagactccacgaattgcacctgacacatgacacctcttaagagggcaacgaggaaaacccagctcagcccaaactccatggtgagtcctctgtgttcagtgatgatcaccgagtgggaaacaccggcgacttccagtgctggactcgtctcccaggggcccccaaacccttcgatcgcgtctaaatcgaagcaccggtcgtggtatatactgtctgatgggcgcgaggaggcgataccg

SEQ ID NO: 794608 - DNA, 615 bp, Homo sapiens
  misc_feature: 81147.UNK.UNK.UNK.pb.heavy.1.raw 81147
cccgacacgcttgctagggacttggagctaaggacgacatattgcctttaggacagtcgaaggtgacgccttagctaccactgaacgtttaggcgccagatgcgtctgggatgacctaactcgcagcttatcgatgatctactgcacgctcaaaccaaccaggtcttgatgcgcgcgattaggactgacgggatcgctacagacatttaactcgctagtaacttaattgagatcctagggatgggataggaaatagaatccacccctatcaccccccacatagcctgccttggggtgttgagtttacttttatttcgtgttggaatgagttgaacttccgggaagtggagtaatgggtttgtctacttcccctaaccgcaaagtactagttttacgagtggcgttgcaagccatagcccagtcacaggtaataaaacaatcaacgtggcgtaaagattggccgcttgctgtgggcattgcaagctggggtttgcagcattgtgcatgctagaacgacaatatgaatctgcgggacccctagtggccaaggatgggccgctagcgggttccgcagcttttgacctggaccagggtgcatagcctgcccagccttct

SEQ ID NO: 794609 - DNA, 696 bp, Homo sapiens
  misc_feature: 81156.44.74.G08.1.pb.heavy.1.raw 81156
ctatgcgccttgccagcccgctcagacagtatattagggaagtagtccttgaccaggcagcccagggccgctgtgccccagaggtgctcctggagcagggcgccagggggaagaccgatgggccccttgggtggaagctgaggtgacaatgaccagggttccctgcccccagatctcaaaggctccatgcgagctggggtacggaccgtctcgcacagtagtagacggccgtgtcgtcggatttcaaagaactcattgtcatggagactgtgtctgtggacttgtccgcggtaatcgtaattctgccccggaagtctcgtgcgtaggtgagtgagccaaaagagggatgattccacccatccactcaagcccttgtccaggggcctggcgcaccccagttgatggtataagtagtggaactggtagtacttccagaggccgtgcaggaaagggtcaccgaggaccaaggttgcggcattctagtcccagactgcacagttgcaccagggactggacacctgttgctgctgccaccacaaagaggaacctccaggtccagtccatggtgatgagctgtgctcccaggggcttctttagaggaggaatgtgttgttatgtgatgctccccctgatagagctactaaatcgagcaccggtcgtgtatatactgtctgatggcgcgagggaggcgatacg

SEQ ID NO: 794610 - DNA, 622 bp, Homo sapiens
  misc_feature: 81166.44.23.C01.1.pb.heavy.1.raw 81166
cgtatcgcctccctcgcgccatcagacagtatatacacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactgggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatgggggccgtggcaccctggtcactgtctcctcagcttccaccaagggcccatcggtcttccccctggcgccctgctccaggaggcacctctgggggcacagcgccctgggctgcctggtcaaggactacttcctatatactgtctgagcgggctggcaagggcgcatag

SEQ ID NO: 794611 - DNA, 609 bp, Homo sapiens
  misc_feature: 81173.44.36.D03.1.pb.heavy.1.raw 81173
cgtatcgcctccctcgcgccatcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgacgaaaaatcctacagtacatctctgaagagcagtttaaccatctccaaggacacctccaaaaggcaggtggtctttagtatgacccaacatggaccctgcggacacaggcacatattactgtgcacgggtaatgcgggaaagaaacagctggtttctgtattataagtcttacatctggacgtctggggcaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794612 - DNA, 573 bp, Homo sapiens
  misc_feature: 81179.44.78.H01.1.pb.heavy.1.raw 81179
cgtatcgcctccctcgcgccatcagacagtatatacacgaccggtgctcgatttagtgtgagtagtttgggtttgggtgccgaagttgctggaggtcacggtcaccacgctgctgagtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcggggctggcaaggcgcatag

SEQ ID NO: 794613 - DNA, 678 bp, Homo sapiens
  misc_feature: 81182.44.35.D02.1.pb.heavy.1.raw 81182
ctatgcgccttgccagcccgctcagacagtatataggaagtagtccttgaccaggcagcccagggccgctgtgcccccagaggtgctcttggaggagggtgccaggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttgtgctggccactgttatagatgcgcccaatccactccagtcccttcccggcggactgccgcagccaactccaataataactactgatgtaaccaccagagacattgcaggtgagggacaggtctccgaaggcttcacccgtcctgggcccgactcctgcagctgcacctcggacacgacccatctgggaggtgccaccaggaggaggaaagaaccacaggtgtttcatgttcttgtgcaggaggcccatgagtctcagaaagtatccccaaacccaactatcgtgtgctaaatcgagcaccggtcgtgtatatactgtctgatggcgcgagggaggcgatacg

SEQ ID NO: 794614 - DNA, 680 bp, Homo sapiens
  misc_feature: 81201.44.53.E09.1.pb.heavy.1.raw 81201
cgtatcgcctccctcgcgccatcagacagtatatacacgaccggtgctcgatttagagagagtgtgttgagctctgggagaggagccccagccttggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794615 - DNA, 706 bp, Homo sapiens
  misc_feature: 81210.44.36.D03.1.pb.heavy.1.raw 81210
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgtttgttttttacaaggtgtccagagtgaagtgcagttggtggagtccgggggagacttggtccagcctggagggtccctgagactctcctgtgtcgcctctggattcaccatcagtgaccactatatggactgggtccgccaggctcccagggaaggggctgggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctggctgcctggtcaaggactacttcctatatactgtctgagcgggctggcaaggcgcatag

SEQ ID NO: 794616 - DNA, 695 bp, Homo sapiens
  misc_feature: 81214.44.74.G08.1.pb.heavy.1.raw 81214
ctatgcgccttgccagcccgctcagacagtatataggaagtagtccttgaccaggcagcccagggccgctgtgccccccagaggtgctcctggagcagggcgccagggggaagaccgatgggcccttggtggaagctgaggtgacaatgaccagggttccctgccccagatctcaaaggctccatgcgagctggggtacggacctctcgcacagtagtagacggccgtgtcgtcggatttcaaagaactcattgtcatggagactgtgtctgtggacttgtccgcggtaatcgtaattctgccccggaagtctccgtgcgtaggtgagtgagccaaaaaagagggatgattccacccatccactcaagcccttgtccaggggcctggcgcacccagttgatggtataagtagtggaactggtagtacttccagaggccgtgcaggaaagggtcaccgaggaccaaggttgcggcattctagtcccagactgcaccagttgcaccagggactggacacctgttgctgctgccaccacaaagaggaacctccaggtccagtccatggtgatgagctgtgctcccaggggcttctttagaggaggaatgtggttgttatgtgatgctccccctgatagagctactaatcgagcaccggtcgtgtatatactgtctgatggcgcgagggaggcgatacg

SEQ ID NO: 794617 - DNA, 694 bp, Homo sapiens
  misc_feature: 81215.44.27.C05.1.pb.heavy.1.raw 81215
ctatgcgccttgccagcccgctcagacagtatataggaagtagtccttgaccaggcagcccagggccgctgtgctctcggaggtgctcctggagcaggcgccaggggaagacgatgggccctggtggaggccgaggagacggtgaccagggttcctgccccaggcgtcgaatgaaccgattttggaaacagatagtctcgcacaaaaatacacggccgtgtcctgaggtctcaggctgttcatttgaagagacactgtgttctcggaattgtctctggagatggtgaatcggccctcaacgaatcaccgtagacttgatttcctccatgaaatgacacacctgccacccactccagcccctcgcctggagcctggcggacccactgcatattccaattatcgaaggtgaatccagaggctgcacaggagagtctcagggaccccctactggggccacgcctcccccagactccacgaattgcacctgacacatgacacctcttaagagggcaacgaggaaaacccagctcagcccaactccatggtgagtcctctgtgttcagtgatgatcaccgagtggaaacaccggcgacttccagtgctgggctcgtctcccagccccaacccttcgatcgcgtctaaatcgagcaccggtcgtgtatatactgtctgatggcgcgagggaggcgatacg

SEQ ID NO: 794618 - DNA, 705 bp, Homo sapiens
  misc_feature: 81217.44.70.G04.1.pb.heavy.1.raw 81217
cgtatcgcctccctcgcgccatcagaacagtatatacacgaccggtgctcgattagtgtagtgtgaagggaaaggggtctgggagaggagcccagcactagaagtcggccggtgtttccattcggtgatcagcactgaaacacagaggactcaccatggagttgggctgagctggtttttcctcgttgctcttttaagaggtgtccactgtcaggtgcacctggtggagtctggggaggcgtggtccagcctgggaggtccctgagactctcctgtgaagcctctggatttagtttcagtggttctggcatgcactgggtccgccaggctccaggcaagggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaaggcccatcggtcttccccctggcgccctgctccaggagcacctccgagagcacagcggccctgggctgcctggtcaaggactacttcctatatactgtctgagcggctggcaaggcgcatag

SEQ ID NO: 794619 - DNA, 654 bp, Homo sapiens
  misc_feature: 81221.44.86.H09.1.pb.heavy.1.raw 81221
ctatgcgccttgccagcccgctcagacagtatataggaagtagtccttgaccaggcagcccagggccgctgtgcccccagaggtgctcctggagcagggcgccagggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgcttcatgttcttgcacaggaggtccttgactctcagaaagcatcccaaacccaagtctatagcactaaatcgagcaccggtcgtgtatatactgtctgatggcgcgagggaggcgatacg

SEQ ID NO: 794620 - DNA, 683 bp, Homo sapiens
  misc_feature: 81222.44.12.B01.1.pb.heavy.1.raw 81222
cgtatcgcctccctcggcgccatcagacagtatatacacgaccggtgctcgatttagtagtgtagattccgcgggggctttctgagagtcatggacctcctgtggcaagaacatgaagcacctgtggttcttccctcctgcctggtggcggcttcccagatgggtcctggtcccaggctgcagctgcaggagtcgggccaggacctggtgaagccttcggagaccctgtccctcacctgccaactgtcttctggtggctccatcagcagtagtagttactactgggggctggatccgccagccccccaggggaaggggctgagtggattgggagtatctattatagtgggagcacctactacaaacccgtccctcaagaggtcgagtcaccatatcagtaggacacgtccaagaaccagttctccctgaagctgagctctgtgaccgccgcggacacggccgtgtattactgtgcgagagtagggcagttcgtcaccaactactttgaccactggggccagggaaccctggtcccaccgtctcctcagcctccaccaagggcccatcggtcttccccctggcaccctcctcccaagagcacctctgggggcacagcggccctgggctgcctggtcaaggactacttcctatatactgtctgagcgggctggcaaggcgcatag

SEQ ID NO: 794621 - DNA, 544 bp, Homo sapiens
  misc_feature: 81253.44.27.C05.1.pb.heavy.1.raw 81253
cgtatcgcctccctcgcgccatcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctgggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794622 - DNA, 710 bp, Homo sapiens
  misc_feature: 81270.UNK.UNK.UNK.pb.heavy.1.raw 81270
ctatgcgccttgccagcccgctcagacagtatataggaagtagtccttgaccaggcagccccagggccgctggtgctctcggaggtgctcctggagcagggcgcccagggggaagaccgatgggcccttggtggaggccgaggagacggtgaccagggttccctggcccaggcgtcgaatgaaccgattttggaaacagatagtctcgcacaaaaatacacggcgtgtcctgaggtctcaggctgttcatttgaagagacactgtgttctcggaattgtctctggagatggtgaatcggccctcaacggaatcaccgtagacttgatttcctccatgaaatgacacacctgccacccactccagcccctcgcctggagcctgggcggacccactgcatattccaattatcgaaggtgaatccagaggctgcacaggagagtctcagggacccccctactgggggccacgcctccccagaactccacgaattgcacctgacacatgacacctcttaagagggcaacgaggaaaacccagctcagcccaaactccatggtgagtcctctgtgttcagtgatgatcaccgagtggaaacaccggcgacttccagtgctgggctcgtctcccaggccccaaacccttcgatcgcgtctaaatcgagcacaccggtcgtgtatatactgtctgatggcgcgagggaggcgatacg

SEQ ID NO: 794623 - DNA, 657 bp, Homo sapiens
  misc_feature: 81276.44.29.C07.1.pb.heavy.1.raw 81276
cgtatcgcctccctcgcgccatcagacagtatatacacgaccggtgctcgatttagagtgctacgaagggaaagggggactctgtgccccaccatggacacactttgctccacgctcctgctgctgaccatcccttcatgggtcttgtcccagatcaccttgaaggagtctggtcctacgctggtgaagcccacacagacctcacgctgacctgcaacctctctgggttctcactcaggagtgagcgattgtgggctgggtccgtcagccccagggaaaggccctggagtggcttgcactcatttattgggatgatgataggcgctacagtccatctctgaagagcagactctccatcaccggagacgcctccaatacgcagggtgatccttagagtggccaacatggcccctgcggacacagccacatactactgcgcacacatgatcaactattataaaagtggtggttatgtgagtggctttgatatctgggccaaaggacaatggtcaccgtctcttcagcctccaccaagggcccatcggtcttccccctgggcgcctgcccaggagcaccttccgagagcacagcgccctgggctgcctggtcaaggactacttcctatatactgtctgagccgggctggcaggcgcatag

SEQ ID NO: 794624 - DNA, 628 bp, Homo sapiens
  misc_feature: 81286.UNK.UNK.UNK.pb.heavy.1.raw 81286
cgtatcgcctccctcgcgccatcagacagtatatacacgaccggtgctcgatttgagtacacgtgattagggattgggggcagggtgaacacctgtggtttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggcctggatccggcagcccccagggagggaatggagtggattggtgacatccattatactgggggcgacgtactactctccgtccctccaagagtcgtctcaccatttcgagggacacgtccatgaaaccgcttctccctgaaaactgacctccgtgaccgccgcggacacggccgtttatttctgtgcgaggcgagactggtctttcaatctatggggccgtggcaccctggtcactgtctcctcagcttccaccaagggccatcggtcttccccctggcgccctgctccaggagcacctctgggggcacagcggccctggggctgctggtcaaggactacttcctatatactgtctgagcgggctggcaaggcgcatag

SEQ ID NO: 794625 - DNA, 590 bp, Homo sapiens
  misc_feature: 81300.44.78.H01.1.pb.heavy.1.raw 81300
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaggcagagttagtatgaccaggagcacctccccaggtacagtctacatggaactgagcagcctgagatctgaggacacggccgtgtatttctgtgcgagagccaccagcacctggcttgacttgtgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794626 - DNA, 646 bp, Homo sapiens
  misc_feature: 81306.44.19.B08.1.pb.heavy.1.raw 81306
cgtatcgcctccctcgcgccatcagacagtatatacacgaccggtgctcgatttagtgagtcagtaagggggactcctgtgccccaccatggacacactttgctccacgctcctgctgctgaccatcccttcatggggcctgtcccagatcaccgtgaaagagtctggccctacattggtgaaacccacacagacctcacgctgacctgcaccgtctcaggcttctcactcgtcactcctggagagggcgttgtctgggtgcggcagcccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794627 - DNA, 708 bp, Homo sapiens
  misc_feature: 81313.44.27.C05.1.pb.heavy.1.raw 81313
cgtatcgcctccctcgcgccatcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794628 - DNA, 711 bp, Homo sapiens
  misc_feature: 81314.44.62.F07.1.pb.heavy.1.raw 81314
ctatgcgccttgccagcccgctcagacagtatataggaagtagtccttgaccaggcagcccagggccgctgtgctctcggaggtgctcctggagcagggcgccagggggaagaccgatgggcccttggtggaggctgaagagacggtcaccactgtcccccggccccaagtactaaggtgtcatggggggtcaccgtggtcctggctttcaaacagtaatagacgcctgtgtcctcgggtctcaggtttttcatttggagaaacaatttgtcctgcgaattgtccctggaaatggtgaagcggcccttcacggagtctccgtagaaagtgacaccaccagctccgatacttgagacccactccagtcccctccctggagcccggcggacccaggtcatgccataggcactaaaggtgaatccagaggccgcacaggagagggtcagggacctcccaggccgaatcaggccccccccagactccaacaactgcacttcacacacgacaccctttaaaaaagccacaagaaaaaggcagctcagcccaaactccatggagacttctctctgttcggtcctggtcaccaaatgaagacacctgaaaatcccagggctgggctcctctctcagagctcccctttccctttatgcgactactaaatcgagcaccggtcgtgtatatactgtctgatggcgcgagggaggcgatacg

SEQ ID NO: 794629 - DNA, 669 bp, Homo sapiens
  misc_feature: 81315.UNK.UNK.UNK.pb.heavy.1.raw 81315
cgtatcgcctcctcgcgccatcagacagtatatacacgaccgtgctcgatttagatctactgacaaccacattcctcctctaaagaagcccctgggagcacagctcatcaccatggactggacctggaggttcctctttgtgtgggcagcagcacagggtgtccagtccctggtgcaacggtgcagtctggactagaatgccgcaaccttggtctccgtgacccgttttttccttgcacggcctctggaagtaactaccagttccacttacttataccatcaactgggtgcgccaggcccctgggacaaggcttgagtggatgggtgaatcatcctctttttggctcactcacctacgcacgagactccgggcagaattacgattaccgcggacaagtccacagacacagtctccatgacaatgagttctttgaatccgacgacacggccgtctactactgtgggccgagggtccgtaacccagctcgcatggagcctttgagatctggggcaggagaaccctggtcattgtcacctcagcttccaccaagggcccatcgtctccccctggcgccctgctccaggagcacctctggggcacagcggcccgggctgcctgtcaaggactacttcctatatactgtctgagcgggctggcaaggcgcatag

SEQ ID NO: 794630 - DNA, 698 bp, Homo sapiens
  misc_feature: 81317.44.36.D03.1.pb.heavy.1.raw 81317
cgtatcgcctccctcgcgccatcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacttggtccagcctggagggtcctgagactctcctgtgtcgcctctggattcaccatcagtgaccactatatggactgggtccgccaggctccaggaaggggctggagtggcttggccgcagtaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggactgtccactggggccagggaaccctggtcaccgtctcctcagcctccaccaagggcccatcggtcttccccctggcgccctgctccaggagcacctccgagagcacagcggccctgggctgcctggtcaagactacttcctatatactgtctgagcgggctggcaggcgcatag

SEQ ID NO: 794631 - DNA, 689 bp, Homo sapiens
  misc_feature: 81331.44.55.E11.1.pb.heavy.1.raw 81331
tatgcgccttgccagcccgctcagacagtatataggaagtagtcttgaccaggcagcccagggccgctgtgcccccagaggtgctctggaggagggtgccaggggaagaccgatgggcccttggtggagcggaggcgacggtgaccagggttccctgggccccagagtcaaacgaataataaccactccgagcgccgacttgtctcgcacagtaatagacggccgtgtcgtcgcctctcaggttgttcatttgaagataaaccgtgttcctggattgtccctggagatggtgaatcgcccttcacggagtctgcgtagtatgtgaaatcaccagtataaatgactgagaccgactccagccccttcctggagcctggcggacccaactcatgtagttgctgctgacggtgagccagaggctgcacaggagagtctctggacccccaggctggactaagcctcctccagactccatcagccgcacctcacactggacaccttttaaagtccacaggagaacccagctcagccaaaactccatggtgagtcctctgtgttcagtgctgatcaccgaatggaaacactcggaatccagtgctgggctcctctcccccccaaacccaacgtgcgagtgctaaatcgagcaccggtcgtgtatatactgtctgatgcgcgagggaggcgatacg

SEQ ID NO: 794632 - DNA, 707 bp, Homo sapiens
  misc_feature: 81337.44.55.E11.1.pb.heavy.1.raw 81337
cgtatcgcctccctcgcgccatcagacagtatatacacgaccggtgctcgatttagcactcgcacgttggggtttggggagaggagcccagcactgggattccgaggtgtttccattcggtgatcagcactgaacacagaggactcaccatggagttttggctgagctgggttctccttgttggacttttaaaaggtgtccagtgtgaggtgcggcctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcacccctcctccaagagcacctctgggggcacagcggccctgggctgcctggtcaaggactacttcctatatactgtctgaggcgggctggcaaggcgcatag

SEQ ID NO: 794633 - DNA, 680 bp, Homo sapiens
  misc_feature: 81361.44.53.E09.1.pb.heavy.1.raw 81361
cgtatcgcctccctcgcgccatcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaagatacggtgtctctgcagatgaacagcctgaacaccgaggacacagccgtctattactgtctgggatggtttcattcgggccagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794634 - DNA, 719 bp, Homo sapiens
  misc_feature: 81364.44.33.C11.1.pb.heavy.1.raw 81364
ctatgcgccttgccagccgctcagacagtatataggaagtagtccttgaccaggcagcccagggccgctgtgccccagaggtgctcttggaggagggtgccaggggaagacgatgggcccttggtggaggctgaggagacggcgaccgtggtccttggccccagcgtccataccattggagagagcagtcatatctgtatcccacgagccccatctctcgcacagtagtagacagccgtgtcctcggctctcaggctattcatttccagatatagtgtgttcttcgaattgtctctggaaatggtgaatcggcccttcacggaatctacataatatttattaacttccatcataccatataagtgccacccactccagtcccttgcctggagcctggcgacccagtgcatgccatgtctgttgaaggtgatccagacgctacacaggagagtctcagggaacctcccaggctggaccacgcctccccagactccaccagcttcacctgacactggacacctcttaaaagagcaacgaggaaaacccaggtcagccaaactccatggtgagtcctctgtttcggtgctgatcaccgactggaaacaccgccgacttctggtgctgggctcctctccagagctccccaaacccaacgagctcactctaaatcgagcaccggtcgtgtatatactgtctgatggcgcgagggaggcgatacg

SEQ ID NO: 794635 - DNA, 674 bp, Homo sapiens
  misc_feature: 81365.44.71.G05.1.pb.heavy.1.raw 81365
cgtatcgcctccctcgcgccatcagacagtatatacacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggagtcggggggaggctttgtacagccggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctggggcaaagggaccccggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794636 - DNA, 679 bp, Homo sapiens
  misc_feature: 81374.44.45.E01.1.pb.heavy.1.raw 81374
ctatgcgccttgccagcccgctcagacagtatataggaagtagtccttggaccaggcagcccagggccgctgtgctctcggaggtgctcctggagcagggcgccagggggaagaccgatggcccttggtggaggctgaggagacggtgaccagggctccctggcccagtagaacgatgggctcgtacaataatagagagccgagtcctcggctctcaaattgttcatttgtagatacacggtgttcttggaattgtctctggagacggagaatcggcccttcacggagtttccatagtattctttacttccatcagaccagatgactgccacccactccagccccttgcctggagcctggcggacccagtgcatggcagagtcactgaaactgagtccggacgcaacacaggagagtctcagggacgtcccaggctggaccacgcctcccccagactccaccagctgaacctgacactggacacctcttaaaagagcaacgaggaaaacccagctcagcccaaactccatggtgagtcctctgtgttcagtgctgatcaccgaatggaaacaccgccgacttctagtgctgggctcctctcccagcccctttcccttactgactcactaaatcgagcaccggtcgtgtatctgtctgatggcgcgagggaggcgatacg

SEQ ID NO: 794637 - DNA, 709 bp, Homo sapiens
  misc_feature: 81398.44.70.G04.1.pb.heavy.1.raw 81398
cgtatcgcctccctcgcgccatcagacagtatatacacgaccggtgctcgatttagtgtagtgtgaagggaaaggggtctgggagaggagcccagcactagaagtcggcggtgttttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcactgggtccgccaggctccaggcaggggccggagtggttggcagttatagcaacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794638 - DNA, 698 bp, Homo sapiens
  misc_feature: 81402.UNK.UNK.UNK.pb.heavy.1.raw 81402
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgacagtgtcccctggccccagtgaaacgcccgataatagctgctgccacttcccgatctcgcacagtaatacagagccgagtcctcgcctctcaggctgatcatttccaggtacagagtgttccgggaattgtctctggagatggtgaatcggccttcacggagtctgcataatatctagaagttccatcatatgctataactgccaaccactccggcccttgcctggagcctggcggacccagtgcatgccagaactactgaaactaaatccagaggcttcacaggagagtctcagggacctcccaggctggaccacgcctccccagactccaccaggtgcacctgacactggacacctcttaaagagtaacgaggaaaacccagctcagcccaaactccatggtgagtcctctgtgttcagtgctgatcaccgaatggaacaccgccgacttctagtgctgggctcctctcccagagctcccctgagcgtagagctaaatcgagcacggtcgtgtatatactgtctgatggcgcgagggaggcgatacg

SEQ ID NO: 794639 - DNA, 699 bp, Homo sapiens
  misc_feature: 81415.44.35.D02.1.pb.heavy.1.raw 81415
ctatgcgccttgccagcccgctcagacagtatataggaagtagtccttgaccaggcagcccagggccgctgtgcccccagaggtgctcttggaggagggtgccagggggaagaccgatggcccttggtggaggcggaggcgacggtgaccagggttccctggccccagaagtcaaacgaataataaccactcgagcgccgacttgtctcgcacagtaatagacggccgtgtcgtcgcctctcaggtgttcatttgaagataaaccgtgttcctggaattgtccctgagatggtgaatcggcccttcacggagtctgcgtagtatgtgaaatcaccagtataatgactgagacccactccagcccttccctggagcctggcggacccaactcatgtagttgctgctgacggtgagcccagaggctgcacaggagagtctctgggaccccccaggctggactaagcctcctccagactccatcagccgcacctcacactggacaccttttaaaagtccaacaggagaacccagctcagccaaactccatggtgagtcctctgtgttcagtgctgatcaccgaatggaaacacctcggaatcccagtgctgggctcctctccccccccaaacccaactatcgtgtgctaaatcgagcaccggtcgtgtatatactgtctgatggcgcgagggaggcgatacg

SEQ ID NO: 794640 - DNA, 623 bp, Homo sapiens
  misc_feature: 81423.44.23.C01.1.pb.heavy.1.raw 81423
ctatgcgccttgccagcccgctcagacagtatataggaagtagtccttgaccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagtttcagggagaagcggttcatggacgtgtccctcgaaatggtgagacgactctgagggacggagagtagtacgtcgccccagtataatggatgtcaccaatccactccattcccctccctgggggctgccggatccagccccaagaatgatcagaactgatggaaactccagagacagtgcagatgagagacagggttcccgaaggcctcaccagtcctgggcccgactcctgcagctgcacctgggacaggacccatctgggagctgccaccagcaggaggaaaaaccacaggtgttcaccccctgccccaatcccctaatcacgtgtactaaatcgagcaccggtcgtgtatatactgtctgatggcgcgagggaggccgatacg

SEQ ID NO: 794641 - DNA, 634 bp, Homo sapiens
  misc_feature: 81430.UNK.UNK.UNK.pb.heavy.1.raw 81430
ctatgcgccttgccagccccgctcagacagtatataggaatagtatccttgaccaggcagcccagggccgctgtgcctcccagaggtgctcctggagcaggggcgccagggggaagaccgatgggcccttggtggaagctgaggagacggtgaccgtggtcccttggccccagacgtccataccgtagtagtagtatgcaactccccgaactcccgcaccggctcttgcacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagcccctctccctggagcttggcggacccagtgcatccagtagctactgaaggtgaaatccagaggctgcacaggagagtctccagggaccaacccccaggctgaactaagcctccccccggactccaccagctgcacctcacactggacaccttttaaaaatagcaacaaggaaaaacccagctatcagatactaaatcgagccaccgggtcgtgtatatactgtctgatggcgcgagggaggcgatacg

SEQ ID NO: 794642 - DNA, 714 bp, Homo sapiens
  misc_feature: 81431.44.70.G04.1.pb.heavy.1.raw 81431
cgtatcgcctccctcgcgccatcagacagtatataacacgaccggtgctcgatttagtgtagtgtgaagggaaaggggtctgggagaggagcccagcactagaagtcggcggttgtttccattcggtgatcagcactgaacacaagaggactcaccatggagtttgggctgagctgggtttttcctcgttgctctttttaagaggtgtccactgtcaggtgcacctggtggagtctgggggaggccgtggtccagccctgggaggtccctgagactctcctgtggaagcctctggattttagtttcagtgttctggcaatgcactgggtccgccaggctccaggcaaggggccggagtggttggcagttatagcacatgatggaagttctgaatattatgcagactccgtgaagggccgattcaccatctcagagacaattcccggaacattggtgtacttggaaatgtcagcctgagagtcgagactcggctctgtattactgtgcgagatcgggaggtggtagtagttattaccggcgcatgactggggccaggggaccctggtcaccgtctcctcagcctccaccaaagggcccatcggtcttcccctggcgccctgctccaggagcacctccgagagcacagcggccctggcctgcctggtccaaggactacttcctatatactgtctgagcggctggcaagcggcatag

SEQ ID NO: 794643 - DNA, 669 bp, Homo sapiens
  misc_feature: 81444.44.23.C01.1.pb.heavy.1.raw 81444
cgtatcgcctcctcgcgccatcagacagtatatacacgaccggtgctcgatttagtacacgtgattaggggattgggggctttcctgaagagtcaaggacctcctgtgcaagaacatgaagcacctgtggtttttcctcctgctggtggcagctcccagatgggtcctgtcccaggtgtagctgcaggagtcgggcccaggactggtgaggccttcgggaaccctgtctctcatcgcactgtctctggagtttccatcagttctgatcattctttggggctggatccggcagcccccagggaggggaatggagtggattggtgacatccattatactgggggcgacgtactactctccgtccatcaagagtcgtctccaccatttccgagggacacgccatgaaccgcttctccctgaaaactgacctccgtgacccgccgccggacacggccgtttattttctgtgcgaggcgagactggtctttcaatctatggggcccgtggcaccctggtcactgtctcctcagcttccaccaagggcccatcgggtcttccccctgggcgccctgctccaggagcacctttctgggggccagcggcccctgggctgcctggtccaaggactatcttcctatatactgtctgagcgggctggcaaggcgcaatag

SEQ ID NO: 794644 - DNA, 611 bp, Homo sapiens
  misc_feature: 81454.UNK.UNK.UNK.pb.heavy.1.raw 81454
cccgacacgcttgctagggacttggagctaagacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagttttactttttatttcgtgttggaatgagttgaacttccggaaagtgagtaatgggtttgtctactttcccctaaccgcaaagtactagttttacgagtggcgttgcaagccatagccagtcacaggtaataaacattcaaccgtggcgtaaagattggccgcttgctgtgggcattgcaagctgggtttgcaggcattgtgcatgctagacgacaatatgaatctgcgggacccctagtggccagatggccgctagcgggttccgcagcttttgaccttggacccagggtgcatagcctgcccagccttc

SEQ ID NO: 794645 - DNA, 698 bp, Homo sapiens
  misc_feature: 81457.44.55.E11.1.pb.heavy.1.raw 81457
cgtatcgcctccctcgcgccatcagacagtatatacacgaccggtgctcgatttagcactcgcacgttgggtttgggagaggagcccagcactgggattccgaggtgtttccattcggtgatcagcactgaacacagaggactcaccatggagttttggctgagctgggttctccttgttggacttttaaaaggtgtccagtgtgagtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcattatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcgagtggttattattcgtttgacttctggggccagggaaccctggtcaccgtcgcctccgcctccaccaaggggccatcggtcttccccctggcaccctcctccaagagcacctctggggcacagcggccctgggctgcctggtcaaggactacttcctatatactgtctgagcgggctggcaaggcgcatag

SEQ ID NO: 794646 - DNA, 602 bp, Homo sapiens
  misc_feature: 81464.UNK.UNK.UNK.pb.heavy.1.raw 81464
gaaggctgggcaggctatgcaccctggtccaggtcaaaagctgcggaacccgctagcggccatctggcccactaggggtcccgcagattcatattgtcgtctagcatgcacaatgctgcaaccagcttgcaatgcccacagcaagcggccaatctttacgccacgtgaattgttattacctgtgactggctatggcttgcaacgccactcgtaaactagtacttgcggtttaggggaagtagacaacccattactccacttcccggagttcaactcattccaacacgaaataaaagtaactcaacaccccaagcaggctatggggggggtgatagggggtggattctatttctatccatcccctaggatctcaattaagttactacggcgagttaaatgtctgtagccgatcccgtcagtcctatcgcggcgcatcaagacctggttggttgagcgtgcagtagatcatcgataagctgcgagttaggtcatcccagaccgcatctggcgcctaaacgttcagtggtagctaaggcgtcaccttcgactgtctaaaggcaatatgtcgtccttagctccaagtccctagcaagcgtgtcggg

SEQ ID NO: 794647 - DNA, 704 bp, Homo sapiens
  misc_feature: 81476.UNK.UNK.UNK.pb.heavy.1.raw 81476
ctatgcgccttgccagcccgctcagacagtatataggaagtagtccttgacaggcagcccaggccgctgtgctctcggaggtgctcctggagcagggccgccaggggaagaccgatgggcccttggtggaggctgaggagacggtgaccagggttccctggccccagtggacagttcctgatataaacacaacacaataatacatgccgtgtcctcggttttcaggttagtcattcgcagaatcaatgagttcttgaagtcatctcttgagagggtgaatctggcttttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcggagcaccggtcgtgtatatactgtctgatggcgcgagggaggcgatacg

SEQ ID NO: 794648 - DNA, 608 bp, Homo sapiens
  misc_feature: 81482.UNK.UNK.UNK.pb.heavy.1.raw 81482
cccgacacgcttgctagggacttggagctaaggacgacatattgcctttagacagtcgaaggtgacgccttagctaccactgaacgtttaggcgccagatgcggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaatagaatccacccctatcacccccccacatagcctgcttggggtgttgagtttacttttatttcgtgttggaatgagttgaacttccgggaagtggagtaatgggtttgtctacttcccctaaccgcaaagtactagttttacgagtggcgttgcaagccatagccagtcacaggtaataaacaattcaacgtggcgtaaagattggccgcttgctgtgggcattgcaagctgggtttgcagcattgtgcatgctagacgacaatatgaatctgcgggacccctagtggccaagatggccgctagcgggttccgcagcttttgacctggaccagggtgcatagcctgcccagccttc

SEQ ID NO: 794649 - DNA, 702 bp, Homo sapiens
  misc_feature: 81496.44.73.G07.1.pb.heavy.1.raw 81496
cgtatcgcctccctcgcggccatcagaaaaaagtatatacacgaccggtgctcgatttagctctacgctcaggggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggaggagcggcccagcctggggaactccctgagactctcctgtgcagcctctggattcatctttcaggaacctatgccatgcactgggtccgccaggctccaggcaagggcttggagtgggtggcaattatatcagaagatggaattgaagcaacactacggagactccgaaagaggccgattcacctctccagagacaattccaaggaacacactgcatctgcaaatgtacaacctcacaagtgaggacacggctgtctattattgtgcgagagccccctcgagacggtcccgcttgactactggggccagggaaccctggcgtcaccgtctccctcagcctccaccaagggccatcggttcttccccctggcgccctgctccaggagcacctccgagagcacagcggcctgggctgcctggtcaaggactacttcctatatactgtctgagcgggctggcaaggcgcatag

SEQ ID NO: 794650 - DNA, 679 bp, Homo sapiens
  misc_feature: 81498.44.71.G05.1.pb.heavy.1.raw 81498
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccggggtccctttgccccagacgtccatgtagtagtaaatacttgtattgttgtaacttctgcgaccctctggcacagtaataaagggccgtgtcgtccactcgcaggctcttcatctgcagaaacaccgtattcttgaattgtccctggagacgatgaagcggcccttcacggagtctgcgacatttgtggcactaccaccagtaatggatgagaccccactccagccccttccctggggcctgacggacccagatcatggcataggtattaaaggcgaatccagaggctgcacaggagagtgtcagggacccccccggctgtaccaagcctccccccgactccaacagctgcacttcacactggacacctttttaaaacagccacaagaaaaaagccagctcagcccaaactccatggtgagttctctctgttcagtccccaggggctgggctcctctctcttgcgacgacactaaatcgagcaccggtcgtgtatatactgtctgatggcgcgagggaggcgatacg

SEQ ID NO: 794651 - DNA, 706 bp, Homo sapiens
  misc_feature: 81519.44.73.G07.1.pb.heavy.1.raw 81519
cgtatcgcctccctcgcgccatcagacagtatatacacgaccggtgctcgatttagctctacgctcaggggagctctgggagaggagcccagcactagaagtcggcggtgtttccattcggtgatcagcactgaacacagaggactcaccatggagtttggctgagctgggttttcctcgttactcttttaagaggtgtccagtgtcaggtgcacctggtggagtctgggggaggcgtggtccagcctgggagggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactggggcccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794652 - DNA, 632 bp, Homo sapiens
  misc_feature: 81523.44.38.D05.1.pb.heavy.1.raw 81523
ctatgccgcccttgccagcccgctcagacagtatatagggaagtagtccttgaccaggcagcccagggccgctgtgccccccagaggtgctcctggagcagggcgccagggggaagaccgatgggccccttggtggaagctgaggagacggtgacccgtggtccccttggccccaggacgtccataccgtagtagtagtatgcaactccccgaactcccgcaccggctcttgcacagtaatacacagccgtgtcctcggctctcagactgttcatttgcagatacagcgtgttcttggcggttgtctctggagatggtgaatcggcccttcacggagtccgcgtagcttgtgctactcccatcactattaatacgtgagaccccacaccagccccttccctggagcttggcggacccagtgcatccagtaagctactgaaggtgaatccagaggctgcacaggagagtctcagggaccccccagggctgaactaagcctcccccggactccaccagctgcacctcacactggacaccttttaaaaatagcaacaaggaaaacccagctatcagatactaaatcgagcaccggtcgtgtatatactgtctgatggcgcgagggaggcgatacg

SEQ ID NO: 794653 - DNA, 680 bp, Homo sapiens
  misc_feature: 81526.UNK.UNK.UNK.pb.heavy.1.raw 81526
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggtgaccagggttccctggccccaggggtcgagccagttcgcccccccgtctctactgtatcgataggaatctctcgcacaataatatacggccgtgtccgcggcggtcacagaagtcaatttcagggagaactggttcttggacctgtctagtgacatggtgactcgactcttgagggcggggttgtagttggtgctgccactgttatagatgcgcccaatccactccagtcccttcccggcggactgccgcagccaactccaataataactactgatgtaaccaccagagacattgcaggtgaggacagggtctccgaaggcttcacccgtcctgggcccgactcctgcagctgcacctcggacacgacccatctgggaggtgccaccaggaggaggaagaaccacaggtgtttcatgttcttgtgcaggaggcccatgagtctcagaaagtatccccaaacccaactatcgtgtgctaaatcgaggcaccggtcgtgtatatactgtctgatggcgcgaggggaggcgatacg

SEQ ID NO: 794654 - DNA, 711 bp, Homo sapiens
  misc_feature: 81539.44.36.D03.1.pb.heavy.1.raw 81539
ctatgcgcccttgccagcccgctcagacagtatataggaagtagtcccttgaccaggcagcccagggccgctgtgctctcggaggtgctcctggaagcagggcgccagggggaagaccgatgggcccttggtggaggctgaggagacggtgaccagggttccctggccccagtggacagttcctgatataaacaccaacacaataatacatgcccgtgtcctcggttttcacaggttagtcattcgcagaatcaatgagttcttgaagtcatctcttgagagggtgaatctggctttcacagacgcggccgtactctgtgataaagctggcaacttgtttttactgcggccaagccactccagccccttccctggagcctggcggacccagtccatatagtggtcactgatggtgaatccagaggcgacacaggagagtctcagggaccctccaggctggaccaagtctcccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 794655 - DNA, 591 bp, Homo sapiens
  misc_feature: 81541.44.78.H01.1.pb.heavy.1.raw 81541
cgtatcgcctccctcgcgccatcagacagtatatacacgaccggtgctcgatttagtgtgagtagtttgggtttggggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctcccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794656 - DNA, 714 bp, Homo sapiens
  misc_feature: 81548.44.56.F01.1.pb.heavy.1.raw 81548
ctatgcgccttgccagcccgctcagacagtatataggaagtagtccttgaccaggcagcccagggccgctgtgcccccagaggtgctcctggagcagggcgccagggggaagaccgatgggccccttggtggaagctgaagagacggtgaccattgtcccctggccccaaatatcaaatgcatcgacgtcccaggatcgcctggcgcagtaatagacgcctgtgtcgtcggtctcaggttgctcatttgtaaatggccaacactgttggagtcatcccttgagacggtgaatcttcccttcacagacgcggcgtactctttacttccaccataacgtttcattctgacgaaagtgatccactcaagccccttccctggagcctgacggacccaggccaagtgataatcactaagactgaatcctgagactacacaggagagtctcagagaccgccctggctgtgccaagccccccccgactccgccagtcgcccctcgcactggacaccttctaaaaaaactacaaggaaaatcaagattagcccaaactccatggttggtggtctgtgctcagtgctgatcaccaagtggaaactcctgggaatctcacggctggggctcctctcccagagctcccctttgtgtgttcagacgtctgctaaatcgagcaccggtcgtgtatatactgtctgatggcgcgagggaggcgatacg

SEQ ID NO: 794657 - DNA, 697 bp, Homo sapiens
  misc_feature: 81558.44.55.E11.1.pb.heavy.1.raw 81558
cgtatcgcctccctcgcgccatcagacagtatatacacgaccggtgctcgatttagcactcgcacgttgggtttggggagaggagcccagcactgggattccgaggtgtttccattcggtgatcagcactgaacacagaggactcaccatggagttttggctgagctggggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggcgattcaccatctccagggacaattccaggaacacggttatcttcaatgaacaacctgagaggcgacgacacggccgtctattactgtgcgagacaagtcggcgctcggagtggttattattcgtttgacttctgggccagggaaccctggtcaccgtcgcctccgctccaccaagggccatcggtcttcccctggcaccctcctccaagagcacctctgggggcacagcggccctgggctgcctggtcaaggactacttcctatatactgtctgagcgggctggcaaggcgcatag

SEQ ID NO: 794658 - DNA, 677 bp, Homo sapiens
  misc_feature: 81559.44.6.A06.1.pb.heavy.1.raw 81559
cgtatcgcctccctcgcgccatcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtggcgccaggcccctggacaagggcttgagtggatgggtggaatcatccctcttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggaggcctttgagatctgggggcagggaaccctggtcattgtcacctcagcttccaccaagggcccatcggtcttccccctggcgccctgctccaggagcacctctgggggcacagcggccctgggctggcctggtcaaggactacttcctatatactgtctgagcgggctggcaaggcgcatag

SEQ ID NO: 794659 - DNA, 701 bp, Homo sapiens
  misc_feature: 81561.44.27.C05.1.pb.heavy.1.raw 81561
cgtatcgcctccctcgcgccatcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtcctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794660 - DNA, 664 bp, Homo sapiens
  misc_feature: 81562.UNK.UNK.UNK.pb.heavy.1.raw 81562
cgtatcgcctccctcgccgccatcagacagtatatacacgaccggtgctcggatttagtgctatagacttgggtttggggatgctttctgagagtcaaggacctcctgtgcaagaacatgaagcacctgtggttttttcctcctgctggtggcagctcccagatgggtccctgtcccaggtgcagctgcaggagtcgggcccaggactggtgaggccttcgggaacccctgtctcctcatctgcactgtctctggagtttccatcagttctgatcattcttgggctggatccggcagcccccagggaggggaaatggagtggattggtgacatccattatactggggcgacgttactactctccgtccctcaagagtcgtctcaccatttcgagggacacgtccatgaaccgcttctccctgaaactgacctccgtgaccgcccgcggacacggccgtttatttctgtgcgaggcgagactggtctttcaatctatggggccgtggcaccctggtcactgtctcctcagcttccaccaagggcccatcggttcttcccctggcgccctgctccaggagcacctcctgggggcacagcggccctgggctgcctggtcaaggactacttcctatatactgtctgagcgggctggcaaggcgcatag

SEQ ID NO: 794661 - DNA, 704 bp, Homo sapiens
  misc_feature: 81571.44.36.D03.1.pb.heavy.1.raw 81571
ctatgcgccttgccagcccgctcagacagtatataggaagtagtccttgaccaggcagcccagggccgctgtgctctcggaggtgctcctggagcagggcgccagggggaagaccgatgggcccttggtggaggctgaggagacggtgaccagggttccctggccccagtggacagttcctgatataaacacaacacaataatacatgcccgtgtcctcggttttcaggttagtcattcgcagaatcaatgagttcttgaagtcatctcttgagagggtgaatctggctttcacagacgcggcgtactctgtgataaagctggcaactttgtttttactgcggccaagccactccagccccttccctggagcctggcggacccagtccatatagtggtcactgatggtgaatccagaggcgacacaggagagtctcagggaccctccaggctggaccaagtctccccggactccaccaactgcacttcactctggacaccttgtaaaataacaacaaggaaaacccagctcagcccgaactccatggtgagtcctctgtgttcagtgctgatcaccaaatgaaaacacctgggaattctggggctggggctccgctctcagagctccccaagagagatcgtgacgcagctaaatcgagcaccggtcgtgtatatactgtctgatggcgcgagggaggcgatacg

SEQ ID NO: 794662 - DNA, 615 bp, Homo sapiens
  misc_feature: 81599.UNK.UNK.UNK.pb.heavy.1.raw 81599
cccgacacgcttgctagggacttggagctaaggacgacatattgcctttagacagtcgaaggtgacgccttagctaccactgaaacgtttaggcgccagatgcggtctgggatgaacctaactcgcagcttatcgatgatctacctgcacggctcaaccaaccaggttcttgatgcgcgcgataggactgacgggatcgctacagacatttaactcgctagtaacttaattgagatcctaggggatgggataggaaatagaatccaccctatcacccccaccatagcctgcttggggtgttgagtttacttttatttcgtgttggaatgagttgaacttccgggaagttggagtaatgggtttgtctacttcccctaaccgcaaagtactagttttacgagtggcgttgcaagccatagccagtcacaggtaataaacaattcaacgtggcgttaaagattggccgcttgctgtgggcattgcaagctgggtttgcagcattgtgcatgctagacgacaaatatgaaatctgcgggacccctagtggccaagatggccgctagcgggttccgcagcttttgacctggaccagggtgcatagcctgcccagccttc

SEQ ID NO: 794663 - DNA, 729 bp, Homo sapiens
  misc_feature: 81602.44.33.C11.1.pb.heavy.1.raw 81602
ctatgcgccttgccagcccgctcagacagtatataggaagtagtccttgaccaggcagcccagggccgctgtgcccccagaggtgctcttggaggagggtgccagggggaagaccgatgggcccttggtggaggctgaggagacggcgaccgtggtcccttggccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctcccaggctggaccacgcctccccagactccaccagcttcacctgacactggacacctcttaaaagagcaacgaggaaaacccaggtcagcccaaactccatggtgagtcctctgtgttcggtgctgatcaccgactggaaaacaccgccgacttctggtgctgggctcctctcccagagctccccaaacccaacgagctcactctaaatcgagcaccggtcgtgtatatactgtctgatggcgcgaggaggcgatacg

SEQ ID NO: 794664 - DNA, 698 bp, Homo sapiens
  misc_feature: 81614.44.36.D03.1.pb.heavy.1.raw 81614
cgtatcgcctccctcgcgccatcagacagtatatacacgaccggtgctcgattagctgcgtcacgatctctctttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 794665 - DNA, 665 bp, Homo sapiens
  misc_feature: 81617.44.86.H09.1.pb.heavy.1.raw 81617
tctatgcgccttgccagcccgctcagacagatataggagtagtccttgaccaggcagcccagggccgctgttgccccagaggtgctcctggagcagggcgccagggggaagaaccgatgggcccttggtggaagctgaggagacagtgaccagggtgccacggccccatagattgaaagaccagtctcgcctcgcacagaaataaacggccgtgtccgcggccggtccacggaggtcagtttcagggagaagcggttcatggacgtgtccctcgaaaatggtgagaacgactcttgagggacggagagtagtacgtcgccccagtataatggatgtcaccaatccactccattccctccctggggggctgccggatccagccccaagaatgatcagaactgatggaaactccagagacagtgcagatgagagacagggttcccgaaggcctcaccagtcctgggcccgactcctgcagctgcacctgggacaggaacccatctgggagctgccaccagcaggaggaaaaaccacaggtgcttcatgttcttgcacagggaggtccttgactctcagaaaagcaatccccaaacccaagtctatagcactaaatcgagcaccggtcgtggtataatactgtctgatggcgcgagggaggcgatacg

SEQ ID NO: 794666 - DNA, 613 bp, Homo sapiens
  misc_feature: 81625.UNK.UNK.UNK.pb.heavy.1.raw 81625
cccgacacgcttgctagggacttggagctaaggacgacatattgcctttagacagtcgaaggtgacgccttagctaccactgaacgtttaggcgccagatgcgggtctgggatgacctaactcgcagcttatcgatgatctactgcacgctcaaccaaccaggtcttgatgcgcgcgataggactgacgggatcgctacagacatttaactcgctagtaacttaattgagatcctaggggatgggataggaaaatagaatccacccctatcaccccccacataggcctgcttggggtgttgagtttacttttatttcgtgttggaatgagttgaacttccgggaagtggagtaatgggtttgtctacttcccctaaccgcaaagtactagttttacgagtggcgttgcaagccataagccagtcacaggtaataaacaattcaacgtggcgtaaagattgggccgcttgctgtgggcattgcaagctgggtttgcagcattgtgcatgctagacgacaatatgaatctgcgggacccctagtggccaagatggccgctagcgggttcccgcagcttttgacctggaccagggtgcatagcctgcccagccttc

SEQ ID NO: 794667 - DNA, 639 bp, Homo sapiens
  misc_feature: 81642.UNK.UNK.UNK.pb.heavy.1.raw 81642
ctatgcgccttgccagcccgctcagacagtattccaggcagcccagggccgctgtgcccccagaggtgctcctggagcagggcgccaggggaagaccgatgggcccttggtggaagctgaggagacagtgaccagggtgccacggccccatagattgaaagaccagtctcgcctcgcacagaaataaacggccgtgtccgcggcggtcacggaggtcagttttcagggagaagcggttcatggacgtgtccctcgaaatggtgagacgactcttgagggacggagagtagtacgtcgccccagtataatggatgtcaccaatccactccattcccctccctgggggctgccggatccagccccaagaatgatcagaactgatggaaactccagaagacagtgcagatgagagacagggttcccgaggcctcaccagtcctgggcccgactcctgcagctgcacctgggacaggacccatctgggagctgccaccagcaggaggaaaaccacaggtgcttcatgttcttgcacaggaggtccttgactctcagaaagcatccccaaacccaagtctatagcactaaatcgagcaccgggtcgtgtatatactgtctgatgggcgcgagggaggcgatacg

SEQ ID NO: 794668 - DNA, 728 bp, Homo sapiens
  misc_feature: 81645.44.86.H09.1.pb.heavy.1.raw 81645
ctatgcgccttgccagcccgctcagacagttatataggaagtagtccttgaccaggcagcccaggccgctgtgccccccagaggtgctcttggaggagggtgccagggggaagaccgatgggcccttggtggaggctgaggagacggcgaccgtggtcccttgccccaggcgtccataccattggagtagagcatgtcatatctgtatccacgagccccatctctcgcacagtagtagacagccgtgtcctcggctctcaggctattcatttccagatatagtgtgttcttcgaattgtctctggagatggtgaatcggcccttcacggaatctacataatatttattacttccatcataccatataagtgccacccactccagtcccttgcctggagcctggcggacccagtgcatgccatgtctgttgaaggtgaatccagacgctacacaggagagtctcagggacctccaggctggaccacgcctcccccagactccaccagcttcacctgacactggacacctcttaaaagagcaacgaggaaaacccaggtcagcccaaactccatggtgagtcctctgtgttcggtgctgatcaccgactggaaacaccgccgacttctggtgctgggctcctctcccagagctccccaacccaagtctatagcactaaatcgagcaccggtcgtgtatatactgtctgatggcgcgagggaggcgatacg

SEQ ID NO: 794669 - DNA, 572 bp, Homo sapiens
  misc_feature: 81678.44.78.H01.1.pb.heavy.1.raw 81678
cgtatcgcctccctcgcgccatcagacagtatatacacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttcccctggcgccctgctccaggagcacctccgagagcacagcggcctgggctggcctggtcaaggactacttcctatatactgtctgagcgggctggcaaggcgcatag

SEQ ID NO: 794670 - DNA, 662 bp, Homo sapiens
  misc_feature: 81712.44.53.E09.1.pb.heavy.1.raw 81712
ctatgcgccttgccagccccgctcagacagtatataggaagtagtccttgaccaggcagcccagggccgctgtgctctcggaggtgctcctggagcagggcgccagggggaagaccgatgggcccttggtggaggctgaggatgaggagacggtgaccgtggtcccttggcccagacgtcccaagcgtagtagaattgagacgacctgccataggcggacccatgtctgacacagtagtagacaagccgtgtcggcggcggccacagaactcactttcagggaaaactgtgtcctcgacgtgtccacggatatggtgactcgacccgttgagggacgggttgtagtaagcgtgttcccactataatagagactcccaatccactgcagccctctcctgggggctggcggattccagccccagtagaaattacttctgtcgatggaggcaccagagaccgtgcacgtgagggacagggtctccgaaggctttcaccagtcctgggccgactcccgcagctgcggctgagacaggacccatctgggaagccgccaccagcaggaggaagaaccacaggtgcttcccccccacccaacacactctctctaaatcgagcaccggtcgtgtatatactgtctgaatggcgcgagggaggcgatacga

SEQ ID NO: 794671 - DNA, 667 bp, Homo sapiens
  misc_feature: 81714.44.29.C07.1.pb.heavy.1.raw 81714
cgtaatcgcctccctcgcgccatcagacagtatatacacgaccggtgctcgatttagagtgctacgaagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggttccgtcagcccccaggaaaggccctggagtggcttgcactcatttattgggatgatgataggcgctacagtccatctctgaagagcagactctccatcaccggagacgcctccaatacgcaggtgatccttagagtggcaacatgggcccctgcggacacagccacatactactgcgcacacatgatcaactattataaaagtggtggttatgtgagtggcttgatatctggggccaagggacaatggtcaccgtctcttcagccctccaccaagggcccatcggtcttcccctggcgccctgctccaggagcacctccgagagcacagcggccctggggctgcctggtccaaggactacttcctatatactgtctgagcgggctggcaaggcgcatag

SEQ ID NO: 794672 - DNA, 693 bp, Homo sapiens
  misc_feature: 81727.44.78.H01.1.pb.heavy.1.raw 81727
cgtatcgcctccctcgcgccatcagacagtatatacacgaccggtgctcgatttagtgtgagtagtttgggtttggggagctctgggagaggagccccagcctttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaaacaccgaggacacagccgtctatttactgtctgggatggtttcattcggccagggaaccctggtcaccgtctcctcagcctccaccaagggcccatcggtcttccccctggcgcctgctccaggagcacctccgagagcacagcggccctgggctgcctggtcaaggactacttcctatatactgtctgagcgggctggcaaggcgcatag

SEQ ID NO: 794673 - DNA, 707 bp, Homo sapiens
  misc_feature: 81735.44.55.E11.1.pb.heavy.1.raw 81735
ctatgcgccttgccagccgcagacagtatataggaaagtagtccttgaccaggcagccagggccgctggcccccaagagtgctcttggaggagggtgccaggggaagaccgatgggcccttggggaggcggaggcgacggtgaccagggttccctggccccagaagtcaaacgaataaaaccactccgagcgccgacttgtctcgcacagtaatagacggccgtgtcgtcgcctcctcaggttgttcatttgaagataaaccgtgttcctggaattgtccctgggagatggtcgaattcggcccgtgtcacggagtctgcgtagtatgtgaaatcaccagtatagaatgactgagacccactccagccccttccctgagcctggcggacccaactcatgtagttgctgctgacggtgagcccagaggctgcaccaggagagtctctgggaccccccaggctgggactaagctcctccagactccatcagccacacctccacactggacaccttttaaaagtccaacaagggagaaacccagctcagccaaaactccatggtgagtctctgtgttcagtgctgatcaccgaatggaaacacctcggaatccccagtgctgggctcctctccccaaacccaacgtgcgagtgctaaaatcgagcaccggtcgtgtatatactgtctgatggcgcgagggaggcgatacg

SEQ ID NO: 794674 - DNA, 606 bp, Homo sapiens
  misc_feature: 81736.UNK.UNK.UNK.pb.heavy.1.raw 81736
gaaggctgggcaggctatgcaccctggtcaggtcaaaagctgcggaacccgctagcggccatcttggccactaggggtcccgcagattcatattgtcgtctagcatgcacaatgctgcaaacccagcttgcaatgcccacagcaagcggccaatctttacgccacgttgaattgtttattacctgtgactggctatggcttgcaacgccactcgtaaaactagtactttgcggttaggggaagtagacaaacccattactccacttcccggaagttcaactcattccaacacgaaataaaagtaaactcaacacccaagcaggctatgtgggggggtgataggggtggattctatttcctatcccatcccctaggatctcaattaagttactagcgagttaaatgtctgtagcgatcccgtcagtcctatcgcgcgcatcaagacctggttggttgagccgtgcagtagatcatcgataagctgcgagttaggtcatcccagaccgcatctggcgcctaaacgtcagtggtagctaaggcgtcaccttcgactgtctaaaggcaatatgtcgtccttagctccaagtccctagcaagcgtgtcggg

SEQ ID NO: 794675 - DNA, 601 bp, Homo sapiens
  misc_feature: NA.44.12.B01.1.PacBio.heavy.1.pb
ttccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatagg

SEQ ID NO: 794676 - DNA, 582 bp, Homo sapiens
  misc_feature: NA.44.19.B08.1.PacBio.heavy.1.pb
aragggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794677 - DNA, 583 bp, Homo sapiens
  misc_feature: NA.44.19.B08.2.PacBio.heavy.1.pb
acgggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcc

SEQ ID NO: 794678 - DNA, 633 bp, Homo sapiens
  misc_feature: NA.44.21.B10.1.PacBio.heavy.1.pb
aaagagagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaargcgcgcatag

SEQ ID NO: 794679 - DNA, 624 bp, Homo sapiens
  misc_feature: NA.44.21.B10.2.PacBio.heavy.1.pb
agagagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccagggaaggggctggagtggcttggccgcagtaaaaacaaagttgccagctttatcacagagtacgccgcgtctgtgaaagccagattcaccctctcaagagatgacttcaagaactcattgattctgcgaatgactaacctgaaaaccgaggacacgggcatgtattattgtgttgtgtttatatcaggaactgtccactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcaatag

SEQ ID NO: 794680 - DNA, 608 bp, Homo sapiens
  misc_feature: NA.44.21.B10.3.PacBio.heavy.1.pb
agagagaggrgcccagccctggggactgaacagagagaactcaccatggagtttgggctgagctggctttttcttgtggctgttttaaaaggtgtccagtgtgaagtgcagctgttggagtcgggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctgggcaaagggaccccggtcaccgtctcctcagcctccaccaagggcccatcggtcttccccctggcaccctcctccaagagcacctctgggggcacagcggccctgggctgcctggtcaaggactacttcctatatactgtctgaggcgggctggcaaggcgcatag

SEQ ID NO: 794681 - DNA, 588 bp, Homo sapiens
  misc_feature: NA.44.23.C01.1.PacBio.heavy.1.pb
ttagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794682 - DNA, 1242 bp, Homo sapiens
  misc_feature: NA.44.23.C01.2.PacBio.heavy.1.pb
tagggattggggcttctgagagtcaaggacctagggatggggagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagcgtatcgcctccctcgcgccatcagacagtatatacacgaccggtgctcgatttagagtaatacatattggtttgggggggagaggagcccagcactgggattccgaggtgtttccattcggtgatcagcactgaacacagaggactcaccatggagttttgctgagctgggtttctccttgttggacttttaaaggtgtccagtgtgaggtgcggctgatggagtctggaggaggcttagtccagcctgggggtcccagaactctcctgtgcagcctctgggctcaccgtcagcagcaactacatgagttgggtccgccaggctccagggaagggctggagtgggtctcagtcattttatactggtgatttcacatactacgcagactccgtgaagggccgattcaccatctccagggacatatccaggaacacggtttatctcaaatgaacaacctgagaggcgacgacacggccgtctattactgtgcgagacaagtcggcgctcggagtggtattattcgtttgacttctggggccaggaacctggtcaccgtcgcctccgcctccaccagggccatcgtcttcccctggcaccctcctccaagagcacctctggggcacagcggccctgggctgcctggtcaaggactacttcc

SEQ ID NO: 794683 - DNA, 640 bp, Homo sapiens
  misc_feature: NA.44.27.C05.1.PacBio.heavy.1.pb
aagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794684 - DNA, 638 bp, Homo sapiens
  misc_feature: NA.44.27.C05.2.PacBio.heavy.1.pb
agggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttcccctggcgccctgctccaggagcacctccgagagcacagcggccctgggctgcctggtcaaggactacttcctatatactgtctgagcgggctggcaaggcgcatag

SEQ ID NO: 794685 - DNA, 600 bp, Homo sapiens
  misc_feature: NA.44.29.C07.1.PacBio.heavy.1.pb
aagggaaagggggactcctgtgccccaccatggacacactttgctccacgctcctgctgctgaccatcccttcatgggtcttgtcccagatcaccttgaaggagtctggtcctacgctggtgaagcccacacagaccctcacgctgacctgcaacctctctgggttctcactcaggagtgatggagcgattgtgggctgggtccgtcagcccccaggaaaggccctggagtggcttgcactcatttattgggatgatgataggcgctacagtccatctctgaagagcagactctccatcaccggagacgcctccaatacgcaggtgatccttagagtggccaacatggcccctgcggacacagccacatactactgcgcacacatgatcaactattataaaagtggtggttatgtgagtggctttgatatctggggccaagggacaatggtcaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcatagg

SEQ ID NO: 794686 - DNA, 665 bp, Homo sapiens
  misc_feature: NA.44.33.C11.1.PacBio.heavy.1.pb
tttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794687 - DNA, 614 bp, Homo sapiens
  misc_feature: NA.44.35.D02.1.PacBio.heavy.1.pb
tttgggtttggggatactttctgagactcatgggcctcctgcacaagaacatgaaacacctgtggttcttcctcctcctggtggcacctcccagatgggtcgtgtccgaggtgcagctgcaggagtcgggcccaggacgggtgaagccttcggagaccctgtccctcacctgcaatgtctctggtggttacatcagtagttattattggagttggctgcggcagtccgccgggaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794688 - DNA, 506 bp, Homo sapiens
  misc_feature: NA.44.37.D04.1.PacBio.heavy.1.pb
ttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattaactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgatag

SEQ ID NO: 794689 - DNA, 613 bp, Homo sapiens
  misc_feature: NA.44.38.D05.1.PacBio.heavy.1.pb
tttgggtttggggggaagaggaagactgacggtcctcccaggagttcaggtgctgggcacctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794690 - DNA, 663 bp, Homo sapiens
  misc_feature: NA.44.39.D06.1.PacBio.heavy.1.pb
ccagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794691 - DNA, 485 bp, Homo sapiens
  misc_feature: NA.44.43.D10.1.PacBio.heavy.1.pb
aaggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggccagggaaccctggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794692 - DNA, 613 bp, Homo sapiens
  misc_feature: NA.44.45.E01.1.PacBio.heavy.1.pb
cctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtctgggggaggcgtggtccagcctgggacgtccctgagactctcctgtgttgcgtccggactcagtttcagtgactctgccatgcactgggtccgccaggctccaggcaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagggatag

SEQ ID NO: 794693 - DNA, 345 bp, Homo sapiens
  misc_feature: NA.44.46.E02.1.PacBio.heavy.1.pb
actggagtggattgggcgcatctataacagtggcagcaccaactacaaccccgccctcaagagtcgagtcaccatgtcactagaccaggtccaagaaccagttctccctgaaattgacttctgtgaccgccgcgracacggccgtatattattgtgcgagagattcctatcgatacagtagagacgggggggccgaactggctcgacccctggggcccagggaaccctggtcaccgtctcctcagcctccaccaagggcccatcggtcttccccctggcaccctcctcccaagagcacctctggggcacagcggccctggggctgcctggtcaaggactacttcc

SEQ ID NO: 794694 - DNA, 617 bp, Homo sapiens
  misc_feature: NA.44.53.E09.1.PacBio.heavy.1.pb
ttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794695 - DNA, 591 bp, Homo sapiens
  misc_feature: NA.44.53.E09.2.PacBio.heavy.1.pb
tttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttccctgaaagtgagttctgtggccgccgccgacacggctgtctactactgtgtcagacatgggtccgcctatggcaggtcgtctcaattctactacgcttgggacgtctggggccaagggaccacggtcaccgtctcctcatcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794696 - DNA, 508 bp, Homo sapiens
  misc_feature: NA.44.53.E09.3.PacBio.heavy.1.pb
ttgggtttgggggaggcgtggtccagcccgggaggtccctgagactctcctgtgtagcctctgggtttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcctatatactgtctgagcggggctggcaaggcgcatag

SEQ ID NO: 794697 - DNA, 648 bp, Homo sapiens
  misc_feature: NA.44.55.E11.1.PacBio.heavy.1.pb
tttgggtttgggttgggttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794698 - DNA, 1308 bp, Homo sapiens
  misc_feature: NA.44.56.F01.1.PacBio.heavy.1.pb
gaaacacacaaaggggagctctgggagaggagccccagccgtgagattcccaggagtttccacttggtgatcagcactgagcacagaccaccaaccatggagtttgggctaatcttgattttccttgtagtttttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatagcgtatcgcctccctcgcgccattcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccgccaggctccaggaaggggctggagtgcttggccgcagtaaaacaaagttgccagctttatcacagagtacgccgcgtctgtgaagccagattcaccctctcaagagatgacttcaagaactcattgattctgcgaatgactaacctgaaaaccgaggacacgggcatgtattattgtgttgtgtttatatcaggaactgtccactgggccagggaaccctggtcaccgtctcctcagcctccaccaagggcccatcggtcttccccctggcgccctgctccaggagcacctccgagagcacagcggcctgggctgcctggtcaaggactacttcc

SEQ ID NO: 794699 - DNA, 589 bp, Homo sapiens
  misc_feature: NA.44.57.F02.1.PacBio.heavy.1.pb
ttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagg

SEQ ID NO: 794700 - DNA, 464 bp, Homo sapiens
  misc_feature: NA.44.57.F02.2.PacBio.heavy.1.pb
ttgggtttggggctgaggtgaagaagcctggggcctcagtgaaggtttcctgcaaggcttctggatacaccttcaatatttatgctatgcagtgggtgcgccaggcccccggacaaaggcttgagtggatgggatggatcaacgctggcaatggtgacacaagatattcacagaagttccagggcagagtcaccattaccagcgacacatccgcgagcacagcctacatggagctgagcagcctgagatctgaagacacggctgtatattattgtgcgagaggaagggggaatgactacggtaactacctctattactactacatggacgtctggggcgaagggaccatggtcaccgtctcctcagcctccaccaagggcccatcgtcttccccctggcgccctgctccaggagcacctccgagagcacagcggccctgggctgcctggtcaaggactacttcc

SEQ ID NO: 794701 - DNA, 611 bp, Homo sapiens
  misc_feature: NA.44.6.A06.1.PacBio.heavy.1.pb
aaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcataga

SEQ ID NO: 794702 - DNA, 649 bp, Homo sapiens
  misc_feature: NA.44.62.F07.1.PacBio.heavy.1.pb
waaagggaaaggggagctctgagagaggagcccagccctgggattttcaggtgtcttcatttggtgaccaggaccgaacagagagaagtctccatggagtttgggctgagctgcctttttcttgtggcttttttaaagggtgtcgtgtgtgaagtgcagttgttggagtctggggggggcctgattcggcctgggaggtccctgaccctctcctgtgcggcctctggattcacctttagtgcctatggcatgacctgggtccgccgggctccagggaggggactggagtgggtctcaagtatcggagctggtggtgtcactttctacggagactccgtgaagggccgcttcaccatttccagggacaattcgcaggacaaattgtttctccaaatgaaaaacctgagacccgaggacacaggcgtctattactgtttgaaagccaggaccacggtgaccccccatgacacctttagtacttggggccgggggacagtggtgaccgtctcttcagcctccaccaagggcccatcggtcttccccctggcgccctgctccaggagcacctccgagagcacagcggccctgggctgcctggtcaaggactacttcctatatactgtctgagcgggctggcaaggcgcataga

SEQ ID NO: 794703 - DNA, 640 bp, Homo sapiens
  misc_feature: NA.44.67.G01.1.PacBio.heavy.1.pb
ttgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactggtgatttcacatactacgcagactccgtgaagggccgattcaccatctccagggacaattccaggaacacggtttatcttcaaatgaacaacctgagaggcgacgacacggccgtctattactgtgcgagacaagtcggcgctcggagtggttattattcgtttgacttctggggccagggaaccctggtcaccgtcgcctccgcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794704 - DNA, 630 bp, Homo sapiens
  misc_feature: NA.44.70.G04.1.PacBio.heavy.1.pb
tctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttccccctggcgccctgctccaggagcacctccgagagcacagcggccctgggctgcctggtcaaggactacttcctatatactgtctgagcggctggcaaggcgcatag

SEQ ID NO: 794705 - DNA, 575 bp, Homo sapiens
  misc_feature: NA.44.70.G04.2.PacBio.heavy.1.pb
actcctgtgccccaccatggacacactttgctccacgctcctgctgctgaccatcccttcatggggcctgtcccagatcaccgtgaaaagagtctggccctacattggtgaaacccacacagaccctcacgctgacctgcaccgtctcaggcttctcactcgtcactcctggagagggcgttgtctgggtgcggcagccccccggaaaggccctggagtggatcgcactcacttattggaatgacgatatacgatatagtccttctctgacgaccagactcacgctcacgaaggacacgtccaaaaaccaggtggtccttacattgaccaacgtggaccctgtggacacaggcacatatttctgtgcccacttcatgaccacaatgaccacgggcttcttcgaaccctggggccagggaatccaggtcaccgtctcatcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794706 - DNA, 621 bp, Homo sapiens
  misc_feature: NA.44.71.G05.1.PacBio.heavy.1.pb
agccccagccgtgagattcccaggagtttccacttggtgatcagcactgagcacagaccaccaaccatggagtttgggctaatcttgattttccttgtagtttttttagaaggtgtccagtgcgaggggcgactggcggagtcgggggggggcttggcacagccagggcggtctctgagactctcctgtgtagtctcaggattcagtcttagtgattatcacttggcctgggtccgtcaggctccagggaaggggcttgagtggatcactttcgtcagaatgaaacgttatggtggaagtaaagagtacgccgcgtctgtgaagggaagattcaccgtctcaagggatgactccaacagtgttggccatttacaaatgagcaacctgagacccgacgacacaggcgtctattactgcgccaggcgatcctgggacgtcgatgcatttgatatttggggccaggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794707 - DNA, 600 bp, Homo sapiens
  misc_feature: NA.44.71.G05.2.PacBio.heavy.1.pb
agcccagccctggggactgaacagagagaactcaccatggagtttgggctgagctggctttttcttgtggctgttttaaaaggtgtccagtgtgaagtgcagctgttggagtcggggggaggcttggtacagccgggggggtccctgacactctcctgtgcagcctctggattcgcctttaatacctatgccatgatctgggtccgtcaggccccagggaaggggctggagtgggtctcatccattactggtggtagtgccacaaatgtcgcagactccgtgaagggccgcttcatcgtctccagggacaattccaagaatacggtgtttctgcagatgaagagcctgcgagtggacgacacggccctttattactgtgccagagggtcgcagaagttacaacaatacaagtattactactacatggacgtctggggcaaagggaccccggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794708 - DNA, 616 bp, Homo sapiens
  misc_feature: NA.44.72.G06.1.PacBio.heavy.1.pb
aagagaggagccttagccctggactccaaggcctttccacttggtgatcagcactgagcacagaggactcaccatggaattgggactgagctgggttttccttgttgctattttagaaggtgtccagtgtgaggtgcaactggtggagtctgggggaggcttggtccagcctggggggtccctgagactctcctgtgcagcctctggattcacctttagtagttattggatgaactgggtccgccaggctccagggaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794709 - DNA, 640 bp, Homo sapiens
  misc_feature: NA.44.73.G07.1.PacBio.heavy.1.pb
aaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagtttcagtagttctggcatgcactgggtccgccaggctccaggcaaggggccggagtggttggcagttatagcatatgatggaacttctagatattatgcagactccgtgaagggccgattcaccatctccagagacaattcccggaacactctgtacctggaaatgatcagcctgagaggcgaggactcggctctgtattactgtgcgagatcgggaagtggcagcagctattatcgggcgtttcactggggccaggggacactggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794710 - DNA, 628 bp, Homo sapiens
  misc_feature: NA.44.73.G07.2.PacBio.heavy.1.pb
aagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatag

SEQ ID NO: 794711 - DNA, 628 bp, Homo sapiens
  misc_feature: NA.44.74.G08.1.PacBio.heavy.1.pb
agggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagacttccggggcagaattacgattaccgcggacaagtccacagacacagtctccatgacaatgagttctttgaaatccgacgacacggccgtctactactgtgcgagaggtccgtaccccagctcgcatggagcctttgagatctgggggcagggaaccctggtcattgtcacctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794712 - DNA, 1187 bp, Homo sapiens
  misc_feature: NA.44.78.H01.1.PacBio.heavy.1.pb
tggaagaggaagactgacggtgccgcacttccaggtacagcatggtgcagtcwcgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagctatgcgccttgccagcccgctcagacagtatataggaagtagtccttgaccaggcagccagggccgcttgctctcggaggtgctcctggagcagggcgccaggggggaagaccgatgggcccttggtggaggctgaggatgaggagacggtgaccgtggtcccttggcccagacgtccaagcgtagtagaattgagacgacctgccataggcggacacatgtctgacacagtaggtagacagccgtgtcgggcggcggcacagacctcactttcagggaaaactgtgtccttcgacgtgtccagggatatggtgcgactcgacccgttgaggacggttgtagtaggtgttcccactataatagagactcccaatccaccctgcagcccctctcctgggggggctggcggatccagcccccagtagaaattaaggttctgtcgatggagggcaccagagaccgtgggcaccgtggagggacagggtctcgaaggctttcaccagtcctggcccgactgcccgcagctgcggctggagacaggacgccatctgggagccgccaccacagggaggagaaccacaggtgcttccccccaaacccaaccacctctctaaatcgagcacccggtcgtgtatatactgtctgatggcgcgagggaggcgatacg

SEQ ID NO: 794713 - DNA, 616 bp, Homo sapiens
  misc_feature: NA.44.78.H01.2.PacBio.heavy.1.pb
aagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccagggaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaarggcgcatag

SEQ ID NO: 794714 - DNA, 597 bp, Homo sapiens
  misc_feature: NA.44.81.H04.1.PacBio.heavy.1.pb
cggggcggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794715 - DNA, 641 bp, Homo sapiens
  misc_feature: NA.44.84.H07.1.PacBio.heavy.1.pb
agctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggcttcccctttaggagctatgccatgacctgggtccgccaggctccagggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaagagggggggggactggatccacagtgggtgggtggttcaactcctggggccagggagccctggtcaccgtcgccgcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794716 - DNA, 658 bp, Homo sapiens
  misc_feature: NA.44.85.H08.1.PacBio.heavy.1.pb
gtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggacatattgtagtactaccacctgctgggactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794717 - DNA, 590 bp, Homo sapiens
  misc_feature: NA.44.86.H09.1.PacBio.heavy.1.pb
tttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatcggtcttccccctggcgccctgctccaggagcacctctgggggcacagcggccctgggctgcctggtcaaggactacttcctatatactgtctgagcgggctggcaaggcgcatag

SEQ ID NO: 794718 - DNA, 663 bp, Homo sapiens
  misc_feature: NA.44.86.H09.2.PacBio.heavy.1.pb
ttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatag

SEQ ID NO: 794719 - DNA, 632 bp, Homo sapiens
  misc_feature: NA.44.9.A09.1.PacBio.heavy.1.pb
aggagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctggagtgggtggcaattatatcagaagatggaattgaagaacactacggagactccgagaagggccgattcaccgtctccagagacaattccaggaacacactgcatctgcaaatgtacaacctcacaagtgaggacacggctgtctattattgtgcgagagccccctcgagacggtccccgcttgactactggggccagggaaccctggtcaccgtctcctcagcctccaccaagggcccatcggtcttccccctggcgccctgctccaggagcacctccgagagcacagcggccctgggctgcctggtcaaggactacttcctatatactgtctggagcgggctggcaaggcggcatag

SEQ ID NO: 794720 - protein, 173 aa, Homo sapiens
  misc_feature: NA.19.53.E09.1.454.heavy.3.nb-aa
MELRLSWIFLLAILKGVQCEVQLVESGGGLVQPGRSLRLSCAASGFTFDDYAMHWVRQAPGKGLEWVSGISWNSASIAYADSVKGRFTISRDNAKNSLYLQMNSLRAEDTALYYCARRYSSYWYDYWGQGTLVTVSSASTKGPSVFPWRPAPGAPPRAQRPWAAWSRTTSHES

SEQ ID NO: 794721 - protein, 174 aa, Homo sapiens
  misc_feature: NA.19.10.A10.1.454.heavy.3.nb-aa
MEFGLSWIFLSAILKGVLCEVRLVESGGGVVQPGGSLRLSCRSYGFNFASGWLCWVRQAPGKGLEWVGRIKRRYEGEATDYAAPVRGRFTMSRDDSQSTVYLQMNSLKTEDTAIYYCTNEYWGRGENWGQGTLVSVSSASTKGPSVFPLAPCSRSTSESTAALGCLVKDYFPRE

SEQ ID NO: 794722 - protein, 180 aa, Homo sapiens
  misc_feature: NA.40.23.C01.1.454.heavy.3.nb-aa
MELGLSWIFLLAILKGVQCEVQLVESGGGLVQPGRSLRLSCAASGFTFGDYAMHWVRQAPGKGLEWVSGISWNSGSIDYGDSVKGRFTISRDNAKNSLYLQMSSLRAEDTALYYCAKDTRGIVVSRRLGAFDIWGQGTMVTVSSASTKGPSVFPLAPCSRSTSESTAALGCLVKDYFQSL

SEQ ID NO: 794723 - protein, 176 aa, Homo sapiens
  misc_feature: NA.5.70.G04.1.454.heavy.3.nb-aa
MELGLNWIFLLAMLKGVQCEVQLVESGGGLVQPGRSLRLSCAASGFTFDDYAMHWVRQAPGKGLEWVSGITWNSGDIGYADSVKGRFTISRDNAKNSLYLQMNSLRVEDTAFYYCAKDRDEVVVAAIDYWGLGTLVTVSSASTKGPSVFPLAPSSKSTSGGTAALGCLVKDYFPCL

SEQ ID NO: 794724 - protein, 175 aa, Homo sapiens
  misc_feature: NA.40.86.H09.1.454.heavy.3.nb-aa
MSVSFLIFLPVLGLPWGVLSQVQLQQSGPGLVKPSQTLSLTCAISGDSVSSNNAAWNWIRQSPSRGLEWLGRTYYRSTWKNDYAASVKSRITIDPDTSKNQFSLQLNSLTPEDTAVYYCAYGSGSYPYWGQGTLVTVSSASTKGPSVFPLAPCSRSTSESTAALGCLVKDYFQSL

SEQ ID NO: 794725 - protein, 166 aa, Homo sapiens
  misc_feature: NA.3.20.B09.1.454.heavy.3.nb-aa
MKHLWFFLLLVAAPRWVLSQVQLQESGPGLVKPSETLSLTCTVSGGSIRPYYWSWLRQPPGKGLEHIGYVFHSGRTDYNASLRSRVTISVDTSKSQFSLKLRAVSAADTAVYYCARLAATDYGGNSYAFDIWGQGTMVTVSSASTKGPSVFPWHPPPRAPLGAQRP

SEQ ID NO: 794726 - protein, 181 aa, Homo sapiens
  misc_feature: NA.48.44.D11.1.454.heavy.3.nb-aa
MEFGLSWVFLVAILKGVQCEVQLVQSGGGLVQPGGSLKLSCTASGFAFTASGFSFSASAMHWVRQASGRGLEWVGRIRTKPNNYATAFAASVRGRFTLLRDDSKNTAYLQMDNLKTEDTAVYYCTSEVTGTAGYWGQGTLVAVSSASTKGPSVFPWRPAPGAPPRAQRPWAAWSRTTSYVY

SEQ ID NO: 794727 - protein, 170 aa, Homo sapiens
  misc_feature: NA.4.30.C08.1.454.heavy.3.nb-aa
MELGLSWVFLVAILEGVQCEVQLVESGGGLVQPGGSLRLSCAASGFTFTTYWMDWVRQAPGKGLEWVANINQDGSEQYYVDSVKGRFTISRDNAKNSLYLQMNSLRAEDTAIYYCVKENWFFDLWGRGTLVTVSSASTKGPSVFPLAPCSRSTSESTAALGCLVKDYFPT

SEQ ID NO: 794728 - protein, 173 aa, Homo sapiens
  misc_feature: NA.48.66.F11.1.454.heavy.3.nb-aa
MEFGLSWVFLVAILKGIQCEEQLVESGGGLVQPGGSLRLSCVASGFTINPYWILWVRQVPGKGLVWVSRIYAAGDTAYADSVKGRFTISRDNAKNTVTLQMDGLRADDTAVYYCAKGPINSYGLDVWGQGTTVSVSSASTKGPSVFPLAPCSRSTSESTAALGCLVKDYFLCI

SEQ ID NO: 794729 - protein, 149 aa, Homo sapiens
  misc_feature: NA.8.39.D06.1.454.heavy.3.nb-aa
MDWTWRVFCLLAVVPGAHSQVQLVQSGAEMKSPGASVKISCKASGYRFTAVYINWLRQAPGQGPEWMGRINPSGGGAEYAQRFQGRVSMTSDTSASTVYMEMRSLRLDDTAVYYCARIEEGGYNHGAFEFWGQGTMVIVSSASTKGPSV

SEQ ID NO: 794730 - protein, 176 aa, Homo sapiens
  misc_feature: NA.19.86.H09.1.454.heavy.3.nb-aa
MDWTWRILLLVAAATGAHSQVQLVQSGAEVKEPGASVKVSCEAFGYTFSHYHILWVRQAPGQGLEWIGRIHGGSGGAYVAQKFQGRVTMAKVASTNTVYMDLSSLRSDDTAMYYCARQDGAKGIKWFDPWGQGTLVTVSSASTKGPSVFPWRPAPGAPPRAQRPWAAWSRTTSHES

SEQ ID NO: 794731 - protein, 149 aa, Homo sapiens
  misc_feature: NA.47.53.E09.1.454.heavy.3.nb-aa
MDTLCSTLLLLTIPSWVLSQITLKESGPTLVKPTQTLTLTCSFSGFSLSSTGEAVGWVRQPPGKALEWLALIYWDDVKYYSPYFKRLTITKDTSKNQVVLTMTNVKPADTATYYCAHRRYTASWEIDNWFDPWGQGTLVTVSSASTKGP

SEQ ID NO: 794732 - protein, 179 aa, Homo sapiens
  misc_feature: NA.9.78.H01.1.454.heavy.3.nb-aa
MEFGLSWVFLVAIIKGVQCQVKLVESGGGLVKPGGSLRLSCAASGFASGLTFSDYYMTWVRQAPGKGLEWVSYIYPSGDTIYYADSVKGRFTISRDNAKNSLTLQMNTLRAEDTAVYYCARITRSPGYYLDTWGQGTLVTVSSASTKGPSVFPWRPAPGAPPRAQRPWAAWSRTTSRRI

SEQ ID NO: 794733 - protein, 151 aa, Homo sapiens
  misc_feature: NA.48.40.D07.1.454.heavy.3.nb-aa
MELGLTWVFLVATLRGVLCEVHLLESGGGLVRPGESLRLACVVSGFTFRNYDMDWVRQAPGKGLEWVSNVNVDGGITKYADSVKGRFTVSRDNGENTLYLQMRNLRGEDTALYYCTTSFYFSNGGSYERHDYWGRGTLVTVSSASTKGPSV

SEQ ID NO: 794734 - protein, 180 aa, Homo sapiens
  misc_feature: NA.48.2.A02.1.454.heavy.3.nb-aa
MELGLSWVFLVAILEGVQCEEQLVESGGGLVQPGGSLRLSCVASGFTFRNNWMTWVRQAPGKGLEWVANINRDGNKIYYVDSVKGRFTISRDNAKSSLFLQMSSLRAEDTALYYCTRDFSPSQSGNYYDAFDIWGQGTVVTVSSASTKGPSVFPLAPCSRSTSESTAALGCLVKDYFLCI

SEQ ID NO: 794735 - protein, 163 aa, Homo sapiens
  misc_feature: NA.40.81.H04.1.454.heavy.3.nb-aa
MDWTWRILFLVAAAAGAHSQVQLVQSGAEVKKPGASVKVSCKISGNTLSNYYIHWMRQAPGQGFEWMGWINPTRGGTKYRQNFQGRVTMTWDASISTVYMDLSGLTSDDTAMYYCGRDVGGYRGADHWGQGTLVTVSSASTKGPSVFPWRPAPGAPPRAQRPW

SEQ ID NO: 794736 - protein, 180 aa, Homo sapiens
  misc_feature: NA.51.11.A11.1.454.heavy.3.nb-aa
MEFGLSWVFLVALLRGVQCQVQLVESGGGVVQPGRSLRLSCVFSGFTFRVYDMHWVRQAPGKGLEWVAVISYDGSNKYYADSVKGRFTVSRDNSKNTLYLHMNSLRAEDTGVYYCANLITEDNGNPRPHGTDVWGQGTTVTVSSASTKGPSVFPLAPSSKSTSGGTAALGCLVKDYFLVA

SEQ ID NO: 794737 - protein, 172 aa, Homo sapiens
  misc_feature: NA.3.70.G04.1.454.heavy.3.nb-aa
MEFWLSWVFLVAISKGVQCEVQLVETGGGLIQPGGSLRLSCEVSGFTVSSNYMNWVRQAPGKGPEWVSIIYGDGSTYYADSVQGRFTISRDNFKNTLLLQMNNLRTEDTAVYYCASSTVVNVGVNWGLGTLVTVSSASTKGPSVFPLAPCSRSTSESTAALGCLVKDYFRVR

SEQ ID NO: 794738 - protein, 159 aa, Homo sapiens
  misc_feature: NA.5.41.D08.1.454.heavy.3.nb-aa
MDWTWRFLFVVAAATGVQSQVQLVQSGAAVKKPGSSVTLSCKASGATFTNYAFNWVRRAPGQGLEWLGRIIPTVDVANYAQKFQGRVTITADKSASTAYMELNNLRSEDTAVYYCTTCATVTTALLRDLYGLDVWGQGSTVTVSSASTKGPSVFPWHPP

SEQ ID NO: 794739 - protein, 175 aa, Homo sapiens
  misc_feature: NA.3.78.H01.1.454.heavy.3.nb-aa
MDLLCKNMKHLWFFLLLVAAPRWVLSQVQLQESGPGLVKPSETLSLTCSVSGSSISSGYYWGWIRQPPGKGLEWIGRIYHLGTTSYNPSLKSRVIISLDTTKNQFSLNLSSVTAADTAMYYCARAYNYGYSDAFDVWGQGTVVTVSSASTKGPSVFPWHPPPRAPLGAQRPWAAW

SEQ ID NO: 794740 - protein, 180 aa, Homo sapiens
  misc_feature: NA.14.55.E11.1.454.heavy.3.nb-aa
MEFGLSWVFLVALLRGVQCQVQLVESGGGVVQPGRSLTLSCATSGFSFSSYGMHWVRQAPGKGLEWVAVVWYDGSNRKYADAVKGRFTISRDNSNNMLYLQMNSLRAEDTAVYYCVRDGGGGDPGMIVYYYHGLDVWGQGTTVTVSSASTKGPSVFPWHPPPRAPLGAQRPWAAWSRTTS

SEQ ID NO: 794741 - protein, 178 aa, Homo sapiens
  misc_feature: NA.9.33.C11.1.454.heavy.3.nb-aa
MEFGLSWVFLVALLRGVQCQVQLVESGGGVVQPGRSLRLSCAGSGFTFSNYGVHWVRQAPGKGLEWLAVVSSEGSVQYYTDSVKGRFTISRDNSKNTMYLQMDSLRVEDTAVYYCTKEGGYSGSSKYYFDFWGQGTLVTVSSASTKGPSVFPWRPAPGAPPRAQRPWAAWSRTTSRRI

SEQ ID NO: 794742 - protein, 173 aa, Homo sapiens
  misc_feature: NA.51.78.H01.1.454.heavy.3.nb-aa
MELGLSWIFLLAILKGVQCEVLLVESGGGLVQPGRSLRLSCAASGFTFDDYAMHWVRQAPGKGLEWVSRISWNSGSIAYADSVKGRFTISRDNAKNSLYLQMNSLRAEDTALYYCAKAKATAGTQLDYWGQGTLVTVSSASTKGPSVFPWHPPPRAPLGAQRPWAAWSRTTSS

SEQ ID NO: 794743 - protein, 182 aa, Homo sapiens
  misc_feature: NA.16.67.G01.1.454.heavy.3.nb-aa
MELGLSWLFLVAILKGVQCEVQLLESGGGLVQPGGSLRLSCATSGFTFSSYAMSWVRQAPGKGLEWVSTISGSGGTTYFADSVKGRFSISRDTSKNTVYLQVHSLRAEDTAIYYCAKDRFPLRRDGYKIFLRIDFWGQGTLVTVSSASTKGPSVFPLAPSSKSTSGGTAALGCLVKDYFRVV

SEQ ID NO: 794744 - protein, 181 aa, Homo sapiens
  misc_feature: NA.40.22.B11.1.454.heavy.3.nb-aa
MELGLCWVFLVAILEGVQCEVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREPGGYNWRYYYYYGMDVWGQGTTVSVSSASTKGPSVFPLAPCSRSTSGGTAALGCLVKDYFQSL

SEQ ID NO: 794745 - protein, 170 aa, Homo sapiens
  misc_feature: NA.15.87.H10.1.454.heavy.3.nb-aa
MELGLSWVFLVAILEGVQCEVQLVESGGGLVQPGGSLRLSCAASGFIFNSFWMTWVRQGPGKGLEWVANIKQDGSEKYYVDSVKGRFTISRDNAKNLLYLQMNSLRGEDTALYYCARIPPLAGQVSYGMDVWGQGTTVTVSSASTKGPSVFPWHPPPRAPLGAQRPWAAW

SEQ ID NO: 794746 - protein, 180 aa, Homo sapiens
  misc_feature: NA.52.2.A02.1.454.heavy.3.nb-aa
MEFGLSWVFLVALLRGVQCQVQVVESGGGVVQPGRSLRLSCAASGFTFRVYDMHWVRQAPGKGLEWVAVISYDGSKIYYVDSVKGRFIISRDNSENTLYLQMNSLRAEDTAVYYCANLITEDNGGPRPLGAEVWGQGTTVTVSSASTKGPSVFPLAPSSKSTSGGTAALGCLVKDYFLYD

SEQ ID NO: 794747 - protein, 145 aa, Homo sapiens
  misc_feature: NA.16.38.D05.1.454.heavy.3.nb-aa
MEFGLSWVFLVTLLRGVQCQVQLVESGGGVVQPGRSLRLSCAASGFIFNSFPMHWIRQAPGRGLEWVAGVSLDGANTYFADSVKGRFTISRENSNNTLHLQMDTLRPDDTAVYYCVRLLLRSGFDYWGQGSLVTVSSASTKGPSV

SEQ ID NO: 794748 - protein, 195 aa, Homo sapiens
  misc_feature: NA.40.70.G04.1.454.heavy.3.nb-aa
MDLMCKKMKHLWSFLLLVAAPRWVLSQLQLQESGPGLVKPSETLSLTCTVSGASISSTSYYWGWIRQSPGKGLEWIAAISYSENTYYNPSLKSRVTISVDTSNNQFSLNLSPVTVADTAVYYCGRRFRDLGPDYGGPHTEDDFLGMDVWGQGTTVTVSSASTKGPSVFPLAPCSRSTSESTAALGCLVKDYFQSL

SEQ ID NO: 794749 - protein, 177 aa, Homo sapiens
  misc_feature: NA.10.35.D02.1.454.heavy.3.nb-aa
MEFGLRWIFLAAILKGVQCDVQLVESGGGLVKPGGSLRLSCSASGFSVTNAWMSWVRQSPGKGLEWVGLIRSRPDGGTTEYAGFVKGRFAISIDESKNTVYLEMSSLESDDTGLYYCTTKSPTKTVGRDCWGQGALVTVSSASTKGPSVFPWRPAPGAPPRAQRPWAAWSRTTSHYY

SEQ ID NO: 794750 - protein, 175 aa, Homo sapiens
  misc_feature: NA.49.31.C09.1.454.heavy.3.nb-aa
MEFGLSWLFLVAFLKGVQCEVELLESGGGLVQFGGSLGLSCAASGFTFSSYGMNWVRQAPEKGLEWVSGISGSGGITSYVDSVKGRFTISRDNSKNKLYLHMESLRAEDTAIYYCARRGNYLGGAFDVWGQGTMVTVSSASTKGPSVFPWHPPPRAPLGAQRPWAAWSRTTSSLD

SEQ ID NO: 794751 - protein, 169 aa, Homo sapiens
  misc_feature: NA.10.38.D05.1.454.heavy.3.nb-aa
MEFWLSWVFLVAISKGVHCEVQLVETGGGWIQPGGSLRLSCAASGFSISNDYMTWARQAPGKGLEWVSVIETDGTTYYSDSVKGRFTLSRDTSNNILYLHMHNLRVDDTATYYCARHDYAQFWGQGAQVTVSPASTKGPSVFPLAPCSRSTSESTAALGCLVKDYFPLL

SEQ ID NO: 794752 - protein, 176 aa, Homo sapiens
  misc_feature: NA.16.71.G05.1.454.heavy.3.nb-aa
MESGLSWLFLVAILKGVQCEVQLLESGGGLAQPGGSLRLSCAASGFTFDSYAMTWVRQAPGKGLEWVSGITGGGYTTYYADSVKGRFTISRDNSKNTLYLQMNSLRADDTAIYYCAKAPAVSHPYYFDYWGQGTLVTVSSASTKGPSVFPLAPSSKSTSGGTAALGCLVKDYFRVV

SEQ ID NO: 794753 - protein, 174 aa, Homo sapiens
  misc_feature: NA.47.85.H08.1.454.heavy.3.nb-aa
MEFGLSWVFLVALLRGVQCQVRLVESGGGVVQPGTSLRLSCAASGFTFNNYAMQWVRQAPGKGLEWVAVISSSGHLQYYADSLRGRFTISRDNSQNTVYLHLTSLRTDDTSLYYCARELTSHCELDSWGQGTLVIVSSASTKGPSVFPWRPAPGAPPRAQRPWAAWSRTTSYVS

SEQ ID NO: 794754 - protein, 177 aa, Homo sapiens
  misc_feature: NA.48.60.F05.1.454.heavy.3.nb-aa
MELGLRWVILVAILEGVQCEVQLVESGGGLVKPGGSLRLSCAASGFTFSTYTMNWVRQAPGKGLEWVSSISSSSNYIDDADSVKGRFTISRDNAKHSLYLQMNSLRADDTAVYYCARLGREWDLLFHFDYWGQGTLVTVSSASTKGPSVFPLAPSSKSTSGGTAALGCLVKDYFLCI

SEQ ID NO: 794755 - protein, 174 aa, Homo sapiens
  misc_feature: NA.48.1.A01.1.454.heavy.3.nb-aa
MELGLRWVFLVAILEGVQCEVQLVESGGGLVKPGGSLRLSCATSGFTFTRYTMNWVRQAPAKGLEWVSSISSGSSYLHYADSVKGRFAISRDNANNSLFLQMDNLRGEDTAVYYCVSPYIAARGTDYWGQGTLVTVSSASTKGPSVFPWRPAPGAPPRAQRPWAAWSRTTSYVY

SEQ ID NO: 794756 - protein, 180 aa, Homo sapiens
  misc_feature: NA.17.10.A10.1.454.heavy.3.nb-aa
MDWTWSILFLVAAGTGAHAQVQLVQTGAEVQKPGASVTVSCKASGYIFTKYGMNWVRQAPGQGLEWVGWVSGFDGKAQYAPKMKGRVTITTDTPTNTVYMQLTSLRADDTAVYYCARMFSVIVQFDRLYGLDFWGQGTTVIVSSASTKGPSVFPLAPSSKSTSGGTAALGCLVKDYFPSL

SEQ ID NO: 794757 - protein, 179 aa, Homo sapiens
  misc_feature: NA.9.31.C09.1.454.heavy.3.nb-aa
MEFGLSWIFLAAILKGVQCEVQLVESGGGSVKPGESLRLSCATSGFNFDIAWMSWARQAPGKGLEWVGRLKSKGSGGTADYASSVKGRFSISRDDARQMMYLQMNSLKIGDTALYFCVFISQWELRFTVGDFWGRGAMVTVSSASTKGPSVFPLAPCSRSTSESTAALGCLVKDYFQTY

SEQ ID NO: 794758 - protein, 172 aa, Homo sapiens
  misc_feature: NA.52.19.B08.1.454.heavy.3.nb-aa
MEFGLSWVFLVALLRGVQCQVQLVESGGGVVQPGRSLRLSCAASGFTFRVYDMHWVRQAPGKGLEWVAFISYDGSKIYYVDSVKGRFIISRDNSENTLYLQMIRLRAEDTALYYCANLITEDNGDPRPLGAEVWGQGTTVIVSSASTKGPSVFPLAPSSKSTSGGTAALGCL

SEQ ID NO: 794759 - protein, 177 aa, Homo sapiens
  misc_feature: NA.16.68.G02.1.454.heavy.3.nb-aa
MKHLWFFLLLVAAPRWVLSQEQLQESGPGLVKPSETLSLTCTVSGGSFSSYYWSWIRQLPGKGLEWIAYISYSGSSNYNPSLKSRVDILVDTSKNQFSLRLRSVTAADTALYYCARGPLSSDYDPRPFDSWGQGTLVTVSSASTKGPSVFPLAPCSRSTSESTAALGCLVKDYFRVV

SEQ ID NO: 794760 - protein, 173 aa, Homo sapiens
  misc_feature: NA.15.34.D01.1.454.heavy.3.nb-aa
MELGLSWVFLVAILEGVQGEVQVVESGGGLVQPGGSLRLSCAASGFSSSKYWISWVRQAPGKGLEWMANMNQDGSDKHHVGSVQGRFTISRDNAKNLVYLQMNSLRADDTAVYYCAGGPEWYLDTFWGQGTLVTVSSASTKGPSVFPLAPCSRSTSESTAALGCLVKDYFRYV

SEQ ID NO: 794761 - protein, 165 aa, Homo sapiens
  misc_feature: NA.15.16.B05.1.454.heavy.3.nb-aa
MELGLSWVFLVAILEGVQCEVQLVESGGGLVQPGGSLRLSCEASGFTLSTYWMTWVRQAPGKGLEWVATIQKDGSDTTYVNSVMGRFTVSRDDAKNSLHLQMNNLRAEDTAVYYCVRDVLRWGQGTLVTVSSASTKGPSVFPLAPCSRSTSESTAALGCLVKDYF

SEQ ID NO: 794762 - protein, 183 aa, Homo sapiens
  misc_feature: NA.49.43.D10.1.454.heavy.3.nb-aa
MEFGLSWLFLVAILKGVHCEVQLLESGGDLVKPGGSLRLSCAVSGFTFRVYAMHWVRQAPGKGLEWVSAISGSGDLRYYGDSVKGRFTISRDNSKNTLYLHMKNLRADDTAVYYCAKWVMDYDDTSGYYSGDYFDYWGQGTLVTVSSASTKGPSVFPLAPSSKSTSGGTAALGCLVKDYFLSR

SEQ ID NO: 794763 - protein, 179 aa, Homo sapiens
  misc_feature: NA.10.79.H02.1.454.heavy.3.nb-aa
MEFGLSWVFLVAIIKGVQCQVKLVESGGGLVKPGGSLRLSCAASGFASGLTFSDYYMTWVRQAPGKGLEWVSYIYPSGDTIYYADSVKGRFTISRDNAKNSLTLQMNTLRAEDTAVYYCARITRSPGYYLDTWGQGTLVTVSSASTKGPSVFPLAPCSRSTSESTAALGCLVKDYFPLL

SEQ ID NO: 794764 - protein, 166 aa, Homo sapiens
  misc_feature: NA.51.80.H03.1.454.heavy.3.nb-aa
MSVSFLIFLPVLGLPWGVLSQVQLQQSGPGLVKPSQTLSLTCAISGDSVSSNSAAWNWIRQSPSRGLELLGRTYYRSKWFNDYAVSVKSRITINPDTSKNQFSLQLNSVTPEDTAVYYCARGWLTAGGFDYWGQGTLVTVSSASTKGPSVFPWRPAPGAPPRAQRP

SEQ ID NO: 794765 - protein, 177 aa, Homo sapiens
  misc_feature: NA.4.19.B08.1.454.heavy.3.nb-aa
MEFGLSWVFLVVLLRGVQCQVKLVDSGGGVVQPGRSLRLSCIASGFTFGSYAMHWVRQAPGKGLEWVAAISYDGSDKYYIESVKGRFTISRDNRKNTLYLEMTSLRGDDTGVYYCARDRGSSWIQLWFDYWGHGTLVTVSSASTKGPSVFPLAPCSRSTSGGTAALGCLVKDYFPTV

SEQ ID NO: 794766 - protein, 177 aa, Homo sapiens
  misc_feature: NA.10.28.C06.1.454.heavy.3.nb-aa
MELGLCWVFLVAILEGVRCEVQLVESGGGLVQPGGSLRLSCVASGFTFSSYSMNWVRQAPGKGLEWVSYIDRNSGTIYYADSVRGRFTISRDNARNSLYVEMNSLRAEDTALYYCARAPKIGSTITHSDYWGQGTLVTVSSASTKGPSVFPWRPAPGAPPRAQRPWAAWSRTTSHYY

SEQ ID NO: 794767 - protein, 175 aa, Homo sapiens
  misc_feature: NA.51.46.E02.1.454.heavy.3.nb-aa
MEFGLSWVFLVALLRGVQCQVQVVESGGGVVQPGRSLRLSCAASKFSFSRFGVHWVRQAPGKGLEWVAVISYDGKNKYYGDSVKGRFTISRDNLKETVHLQMNSLRGDDTAVYYCHLESSNWREVFDIWGQGTMVTVSSASTKGPSVFPLAPSSKSTSGGTAALGCLVKDYFLVA

SEQ ID NO: 794768 - protein, 165 aa, Homo sapiens
  misc_feature: NA.52.14.B03.1.454.heavy.3.nb-aa
MDLLCKNMKHLWFVLLLVAAPRWVLSQLQLQESGPGLVKPSETLSLTCTVSGGSISSSDYYWGWIRQPPGKGLEWIGSVFYSGNTYYNPSLKSRVTISVDTSKSQFSLKLTSLNAADTAVYYCASTPEPFYDFWSGYYTGMGPFDFWGQGTLVTVSSASTKGPSV

SEQ ID NO: 794769 - protein, 173 aa, Homo sapiens
  misc_feature: NA.22.36.D03.1.454.heavy.3.nb-aa
MEFGLKWLLLVAILKGVKCAVKVLESGGGLVQPGGSLTLSCAASGFTVSSNAMSWVRQAPGKGLQWVSGIGSDGATHYADSVRGRFIISRDDSENTVNLQMYSLSAEDTAVYFCAKDLYFWAAADYWGQGTLVTVSSASTKGPSVFPWRPAPGAPPRAQRPWAAWSRTTSTRM

SEQ ID NO: 794770 - protein, 177 aa, Homo sapiens
  misc_feature: NA.19.85.H08.1.454.heavy.3.nb-aa
MELGLCWVFLVAILAGVQCEVELVESGGGLVQPGGSLRVSCTASGFTFSNYEMDWIRQAPGKGLEWIAYVTSEGEVTSYADSVRGRFTISRDNAKKTLFLQLDGLRVEDTAIYYCVREGGTGWSGRSFDLWGQGSSVSVSSASTKGPSVFPLAPSSKSTSGGTAALGCLVKDYFPRE

SEQ ID NO: 794771 - protein, 181 aa, Homo sapiens
  misc_feature: NA.51.31.C09.1.454.heavy.3.nb-aa
MESGLTWLFLVAILKGVQCDVQLVESGGGLIQPGGSLRLSCRTSGFMFRVYDMSWVRQAPGKGLEWVSMISDGGTTTNYADSVKGRCTISRDNSKDTLYLQLNRLTPADTAVYYCVKEDGPLDEEPEENHYFDYWGQGRLVTVSSASTKGPSVFPLAPSSKSTSGGTAALGCLVKDYFLVA

SEQ ID NO: 794772 - protein, 183 aa, Homo sapiens
  misc_feature: NA.9.70.G04.1.454.heavy.3.nb-aa
MKHLWFILLLVAAPRWVLSQVRLQESGPGLVKPSQALSLTCTVSGDSIRGGRSYWTWIRQSAGKGLEYIGRIYASGTAIYNPSLKSRVSMSVDTSQNQFSLTVSYMTAADTAVYYCAREAVILGPAVKNSYYGLDVWGQGTKVTVSSASTKGPSVFPWRPAPGAPPRAQRPWAAWSRTTSRRI

SEQ ID NO: 794773 - protein, 179 aa, Homo sapiens
  misc_feature: NA.13.79.H02.1.454.heavy.3.nb-aa
MELGLSWVFLVAILEGVQCEVQLVESGGGLVQPGGSLRLSCAASGFTFSSYWMSWVRQAPGKGLEWVANIKQVGSEKYYVDSVKGRFTISRDNAKNSLYLQMNSLRAEDTAVYYCARDWGGRYSSGTYYFDYWGQGTLVTVSSASTKGPSVFPLAPSSKSTSGGTAALGCLVKDYFLVR

SEQ ID NO: 794774 - protein, 185 aa, Homo sapiens
  misc_feature: NA.49.46.E02.1.454.heavy.3.nb-aa
MDLLCKNMKHLWFFLLLVAAPRWVLSQLQLQESGPGLVKPSETLSLTCTVSGGSMSSSNYYWGWVRQPPGKGLEWIGSIYFTGTSYYNPSLKSRVTISEDTSKNQFSLKLTSVTAADTAVYYCGVPAVGYYYYYGVDVWGQGTTVTVSSASTKGPSVFPLAPSSKSTSGGTAALGCLVKDYFLSR

SEQ ID NO: 794775 - protein, 184 aa, Homo sapiens
  misc_feature: NA.3.17.B06.1.454.heavy.3.nb-aa
MEFGLSWVFLVVILQGVQCEVHLVESGGGLVQPGGSLRLSCAASGLTFTLNGHYVDWVRQAPGKGLEWVGRSRDTTNSDTAQYAASVKGRFTISRDDSENSLYLQMNSLRTDDTAVYYCVIDLGYNDGGTWYSRWVYWGQGTLVTVSSASTKGPSVFPLAPCSRSTSESTAALGCLVKDYFRVR

SEQ ID NO: 794776 - protein, 172 aa, Homo sapiens
  misc_feature: NA.40.33.C11.1.454.heavy.3.nb-aa
MELGLSWVFLVAILKGVQCEVQLVESGGGLVQPGGSLRLSCAASGVTLSAYWVLWVRQAPGKGLEWVARIYKDGSTAYADSVKGRFTISRDNAKNTVSLQMDSLRAEDTGVYYCTKVGTNEYGVDVWGQGTTVVASYASTKGPSVFPWRPAPGAPPRAQRPWAAWSRTTSSR

SEQ ID NO: 794777 - protein, 178 aa, Homo sapiens
  misc_feature: NA.14.78.H01.1.454.heavy.3.nb-aa
MEFGLSWVFLVAIIKGVQCQVQLVESGGGLVKPGGSLRLSCAASGFTFSDYYMTWIRQAPGKGLEWIAYIHYSGNAVSYADSLKGRFTVSRDNAKNSLYLQIDGLRVEDTAMYYCARVWFGHVLEVGAFDHWGQGTLVTVSSASTKGPSVFPWHPPPRAPLGAQRPWAAWSRTTSVLD

SEQ ID NO: 794778 - protein, 176 aa, Homo sapiens
  misc_feature: NA.8.25.C03.1.454.heavy.3.nb-aa
MEFGLTWVFLVAILKGVQCEVQLVDSGGGLVQPGRSLRLSCTGTGFIFGDYAVTWVRQAPGKGLEWVSLIRSKAYGGTTDYAASVKGRFTISRDDSKSIAFLQMDSLKTEDTGVYYCNRFGSGNPQNDLWGQGTLVTVSSASTKGPSVFPWRPAPGAPPRAQRPWAAWSRTTSDTR

SEQ ID NO: 794779 - protein, 171 aa, Homo sapiens
  misc_feature: NA.2.33.C11.1.454.heavy.3.nb-aa
MDFGLRWIFLAAILKGFHCELRLVASGGGLVQPGGSLRLSCAISEAPSNTVWMNWVRQAPGKGLEWVGHIKSKTAGETTDYAAAFRGRFTIFRDESQSTLFLQMNSLEDADTAMYYCTLGHYSPWGQGTLVTVSSASTKGPSVFPWRPAPGAPPRAQRPWAAWSRTTSCRA

SEQ ID NO: 794780 - protein, 184 aa, Homo sapiens
  misc_feature: NA.48.39.D06.1.454.heavy.3.nb-aa
MDLMCKKMKHLWFFLLLVAAPRWVLSQLQLQESGPGLVKPSETLSLTCTVSGGSISSSTYFWGWIRQPPGKGLEWIGSIYHSGSTYYNPSLKSRGTISVDTSKNQFSLKLSSVTAADTAVYYCARPRAQWLFDAFDMWGQGTMVTVSSASTKGPSVFPLAPSSKSTSGGTAALGCLVKDYFLCI

SEQ ID NO: 794781 - protein, 179 aa, Homo sapiens
  misc_feature: NA.47.38.D05.1.454.heavy.3.nb-aa
MDWTWRILFLVAAATGVHSQLQLVQSGAEVKKPGASVKVSCKASGYSFTDYYLHWVRRAPGQGLEWMGRISPNSGGTNYAQRFQGRVTMTRDTSISTAYMELSSLRPDDTAVYYCALVTDDYDVLIGHYPDVWGKGTTVTVSSASTKGPSVFPLAPSSKSTSGGTAALGCLVKDYFLRE

SEQ ID NO: 794782 - protein, 174 aa, Homo sapiens
  misc_feature: NA.26.71.G05.1.454.heavy.3.nb-aa
MDTLCSTLLLLTIPSWVLSQITLKESGPALVEPTQTLTLTCSVSGFSLTTTEVNVAWVRQAPGKALEWLALIYWSDLKRYNPSLRNRLTITRDTSKDRVVLTMTDMNPVDTGTYYCAHSPSGYARKEYDYWGQGILVTVSPASTKGPSVFPWRPAPGAPPRAQRPWAAWSRTTS

SEQ ID NO: 794783 - protein, 183 aa, Homo sapiens
  misc_feature: NA.52.78.H01.1.454.heavy.3.nb-aa
MELGLSWVFLVAILEGVQCEAQLVESGGGLVQPGGSLTLSCVASGFTFNSYWMTWVRQAPGKGLEWVASVKHDGGEEDYADSVKGRFTTSRDNIKNSMYLQMSSLTSEDTAVYYCARVLWDVVVAPAALPGCYFDLWGRGTLVTVFSASTKGPSVFPWHPPPRAPLGAQRPWAAWSRTTSYTI

SEQ ID NO: 794784 - protein, 181 aa, Homo sapiens
  misc_feature: NA.53.25.C03.1.454.heavy.3.nb-aa
MELGLRWVFLVAFLEGVQCDMQLVESGGGLVKPGGSLRLSCAASGFTFSIYSMNWIRQAPGKGLEWVSSISSSSSYKYYADSVKGRFTVSRDNAKNSLYLQMNSLRAEDTAVYFCARDDPYNSDYYSVDDAFDVWGQGTIVTVSSASTKGPSVFPWHPPPRAPLGAQRPWAAWSRTTSSYC

SEQ ID NO: 794785 - protein, 153 aa, Homo sapiens
  misc_feature: NA.22.38.D05.1.454.heavy.3.nb-aa
MDTLCSTLLLLTIPSWVLSQITLKESGPTLVKPTQTLTLTCTFSGFSLNSSGVGVGWFRQPPGKALEWVALIYWDDGYRYSPSLRRRLTITKDTPKNQVVLTMTTMDPVDTATYFCAHSIGAPGSLPNWFDPWGPGTLVTVSSASTKGPSVFP

SEQ ID NO: 794786 - protein, 145 aa, Homo sapiens
  misc_feature: NA.49.67.G01.1.454.heavy.3.nb-aa
MDWTWRILFLVAAATGAHSQVQLVQSGAEVKRPGASVKVSCKTSGYTFGSYTIHWVRQAPGQGLEWMGWINSDNGSRQHSPKFQDRVTITRDTSANTAYMELSGLRFEDTAVYYCARATVVMGFDYWGQGTPVTVSSASTKGPSV

SEQ ID NO: 794787 - protein, 164 aa, Homo sapiens
  misc_feature: NA.52.15.B04.1.454.heavy.3.nb-aa
MEFGQSWVLLVVLLRGVQCQVQLVESGGGVVQPGRSLRLSCAGSAFPFNNYAIDWVRQAPGKGLEWVAVISADGGTKYYADSARGRFTISRDNSQDVIYLQMNSLRPEDTAVYYCASGGSAWPRDAFDFWGQGTFVTVSSASTKGPSVFPWHPPPRAPLGAQRP

SEQ ID NO: 794788 - protein, 180 aa, Homo sapiens
  misc_feature: NA.51.86.H09.1.454.heavy.3.nb-aa
MEFGLSWVFLVALLRGVQCQVQLVDSGGGVVQPGRSLRLSCAASGFTFNTYGMHWVRQAPGKGLEWLSFISYDGGNKNYADSVKGRFTISRDNSKNTLYLQMNSLRIEDTAVYYCVRGSAYSGFWSNYLLGTFDIWGHGTMVTVSSASTKGPSVFPWRPAPGAPLGAQRPWAAWSRTTSS

SEQ ID NO: 794789 - protein, 183 aa, Homo sapiens
  misc_feature: NA.40.31.C09.1.454.heavy.3.nb-aa
MDLMCKKMKHLWFFLLLVAAPRWVLSQLQLQESGPGLVKPSETLSLTCTVSGGSISSSTYFWGWIRQPPGKGLEWIGSIYHSGSTYYNPSLKSRGTISVDTSKNQFSLKLSSVTAADTAVYYCARPRAQWLFDAFDMWGQGTMVTVSSASTKGPSVFPLAPSSKSTSGGTAARAAWSRTTSSR

SEQ ID NO: 794790 - protein, 176 aa, Homo sapiens
  misc_feature: NA.12.55.E11.1.454.heavy.3.nb-aa
MEFGLSWVFLVALLRGVQCQMQLVESGGGVVRPGTSLTLSCAAAGFTLPSYAMHWVRQAPGKGLEWVAVISYDGSYQYYADSVKGRLTISRDNSRNKLYLQINSLRLEDTAVYYCARDYGDLFWYFDLWGRGTLVTVSSASTKGPSVFPWRPAPGAPLGAQRPWAAWSRTTSYVVL

SEQ ID NO: 794791 - protein, 177 aa, Homo sapiens
  misc_feature: NA.47.46.E02.1.454.heavy.3.nb-aa
MEFGLSWLFLVAFLKGVQCEVQLLESGGDLVHPGGSLRLSCAASGLTFSNSVMGWVRQAPGKGLEWVSSIDENGGSTFYVDSVKGRFTISRDNFRSTLYLQMNSLRAEDTAVYFCAKVYSSAPYAHFFDFWGQGILVTVSTASTKGPSVFPLAPCSRSTSESTAALGCLVKDYFLRE

SEQ ID NO: 794792 - protein, 180 aa, Homo sapiens
  misc_feature: NA.49.8.A08.1.454.heavy.3.nb-aa
MEFGLSWVFLVALLRGVQCQVQLVESGGGVVQPGRSLRLSCAASGFTFRVYDMHWVRQAPGKGLEWVAVISYDGSNIYYVDSVKGRFIISRDNSENTLYLQMNSLRAEDTAVYYCANLITEDNGDPRPLGAEVWGQGTTVIVSSASTKGPSVFPLAPSSKSTSGGTAALGCLVKDYFLSR

SEQ ID NO: 794793 - protein, 188 aa, Homo sapiens
  misc_feature: NA.12.11.A11.1.454.heavy.3.nb-aa
MELGLSWVFLVAILEGVQCEVQLVESGGGLVQPGGSLRVSCTTSGFMFSSHWMNWVRQAPGKGLEWVANIKQDGSEKYYVDSVKGRFTISRDNAKNSLYLQINSLKAEDTAVYFCARTSYGDKFIQTRQSSFAKPSHYFDSWGQGTLVTVSSASTKGPSVFPLAPSSKSTSGGTAALGCLVKDYFLRR

SEQ ID NO: 794794 - protein, 173 aa, Homo sapiens
  misc_feature: NA.19.67.G01.1.454.heavy.3.nb-aa
MEFWLTWVFLAAISGGVQCEVQLVETGGGLVQPGRSLRLSCEPSGVSVSSDCIAWVRQAPGKRPEWVAGIFIGGTTFYGDSMEGRFTISRDFSQNTLSLQMNSLRAEDTAVYYCVRVYGDGWWTDHWGQGTLVTVSSASTKGPSVFPWRPAPGAPPRAQRPWAAWSRTTSHES

SEQ ID NO: 794795 - protein, 179 aa, Homo sapiens
  misc_feature: NA.51.45.E01.1.454.heavy.3.nb-aa
MEFGLSWVFLVALLRGVQCQVRLVESGGGVVQPGDSLRISCAASGFNFNRHPMHWVRQAPGKGLEWVAVISSTGNSKHYGRSVKGPFAISRDNSKNTLYLRMNSLRPEDTAIYFCARGESYCNDGSCYRFDFWGQGTLVTVSSASTKGPSVFPLAPSSKSTSGGTAALGCLVKDYFLVA

SEQ ID NO: 794796 - protein, 158 aa, Homo sapiens
  misc_feature: NA.52.73.G07.1.454.heavy.3.nb-aa
MDLLHKNMKHLWFFLLLVAAPRWVLSQVHLQQWGAGLLKPSETLSLTCAVDGGSFSGRYWTWIRQPPGKGLEWIGEINHTGSINYNPSLKSRVTISVDTSKNQFSLKVRSVTAADTAVYYCAKGPHDENYAPGAMDVWGQGTTVTVSSASTKGPSVFP

SEQ ID NO: 794797 - protein, 179 aa, Homo sapiens
  misc_feature: NA.48.68.G02.1.454.heavy.3.nb-aa
MELGLNWIFLLAILKGVQCELQLVESGGGLVQPGRSLRLSCAASGFTFGDYAMHWVRQAPGKGLEWVSGISWNSDSIGYADSVKGRFTISRDNAKNSLYLQMNSLRTEDTALYYCVKDMIFGVRGVGGGLDYWGQGTLVTVSSASTKGPSVFPLAPSSKSTSGGTAALGCLVKDYFLCI

SEQ ID NO: 794798 - protein, 179 aa, Homo sapiens
  misc_feature: NA.15.67.G01.1.454.heavy.3.nb-aa
MELGLSWVFLVVILEGVQCEVHLVESGGGLVQPGGSLRLSCAVSGFTLRSYWMTWVRQAPGKGLEWVANINKDGSQKNYVDSVNGRFTISRDNAKNSLYLQMNSLRGEDTAVYYCARDDSRLYSSRWYDAFDMWGQGTVVTVTSASTKGPSVFPWRPAPGAPPRAQRPWAAWSRTTSAT

SEQ ID NO: 794799 - protein, 178 aa, Homo sapiens
  misc_feature: NA.8.34.D01.1.454.heavy.3.nb-aa
MEFGLNWVFLVALLRGVQCQVQLVESGGGVVQPGRSQRLSCAASGFTFSNYGMHWVRQAPGKGLEWVAVVSSEGSVQWYADSVKGRFTISRDNSRNTMYLELNSLSPEDTGVYYCTKEGGTSGSSKYSFDVWGQGTLVTVSSASTKGPSVFPLAPCSRSTSESTAALGCLVKDYFRHA

SEQ ID NO: 794800 - protein, 162 aa, Homo sapiens
  misc_feature: NA.10.53.E09.1.454.heavy.3.nb-aa
MEFGLSWVFLVALLRGVQCQVQLVESGGGVVQPGRSLRLSCLASGFTFSSYPLHWVRQAPGKGLEWVAVISFDGDNKYYRDSVRGRFTISKDNLKNTLFLQMNSLRAEDTAVYYCSFGSDSSGEYLQHWGQGTLVTVSSASTKGPSVFPWHPPPRAPLGAQR

SEQ ID NO: 794801 - protein, 181 aa, Homo sapiens
  misc_feature: NA.3.71.G05.1.454.heavy.3.nb-aa
MELGLSWIFLLAILKGVRCEVQLVESGGGLVQPGRSLRLSCAASGFTFDDYAMHWVRQAPGKGLEWVSGITWNSDNIGYADSVKGRFTISRDNAKNSLYLQMNSLRPEDTALYYCVKSRGNMYDFWNSYYRFDYWGQGTLVTASSASTKGPSVFPLAPSSKSTSGGTAALGCLVKDYFRVR

SEQ ID NO: 794802 - protein, 178 aa, Homo sapiens
  misc_feature: NA.8.33.C11.1.454.heavy.3.nb-aa
MEFGLNWVFLVALLRGVQCQVQLVESGGGVVQPGRSQRLSCAASGFTFSSYGMHWVRQTPGKGLEWVAVVSSEGSVQWYADAVKGRFTISRDNSRNTMYLDLNSLSPEDTGVYYCTKEGGTSGSSKYSFDVWGQGTLVTVSSASTKGPSVFPWRPAPGAPPRAQRPWAAWSRTTSDTR

SEQ ID NO: 794803 - protein, 178 aa, Homo sapiens
  misc_feature: NA.13.37.D04.1.454.heavy.3.nb-aa
MEFGLNWLFLVAILRGVQCEVQLLESGGGLVQPGGSLRLSCAASGFSFSSYAMSWVRQAPGKGLEWVSGISALDDSTYYADSVKGRFTISRDNSKNTLYLQMNSLGAEDTAVYHCAKDIVMMVAATTLFDYWGQGTLVTVSSASTKGPSVFPWHPPPRAPLGAQRPWAAWSRTTSVLD

SEQ ID NO: 794804 - protein, 183 aa, Homo sapiens
  misc_feature: NA.10.34.D01.1.454.heavy.3.nb-aa
MEFGLSWIFLAAILKGVQCEVQLVESGGGLVKPGGSLRLSCAASGFTFSNAWMNWVRQAPGKGLEWVGHIKIKADGGTTEHAAPVKGRFSISRDDSKSTLYLNMNSLKTEDTAVYYCATQDRYCSDGVCSKEDLDFWGQGTLVTVSSASTKGPSVFPWRPAPGAPPRAQRPWAAWSRTTSHYY

SEQ ID NO: 794805 - protein, 179 aa, Homo sapiens
  misc_feature: NA.51.43.D10.1.454.heavy.3.nb-aa
MDWTWRILFLVAAATGAHSQVQLVQSGGEVKKPGASVKVSCRASGYTFTGYYIHWVRQAPGQGLEWMGWMKPNSGATKTAQKFQGRVTMTRETSVRTAYMEVTSLSPDDTAIYFCARGISTSGIITWVGNYLHYWGQGTLVTVSSASTKGPSVFPWHPPPRAPLGAQRPWAAWSRTTSS

SEQ ID NO: 794806 - protein, 186 aa, Homo sapiens
  misc_feature: NA.11.67.G01.1.454.heavy.3.nb-aa
MEFGLSWLFLVAILKGVQCEVELLQSGGGLVQPRGSLRLSCVGSGFSFSSYAMTWVRQAPGKGLEWVSAINGHGGKTYYAESVQGRCTISRDNSQKTLYLQMDSLRADDTAVYYCARNPSRYCTGGNCYDAYYYHHMDVWGKGTTVIVSSASTKGPSVFPLAPSSKSTSGGTAALGCLVKDYFRIS

SEQ ID NO: 794807 - protein, 174 aa, Homo sapiens
  misc_feature: NA.4.87.H10.1.454.heavy.3.nb-aa
MDWTWRILFLVAAATGAHSQVQLVQSGAEVRKPGASVKVSCKTSGYTFAGYYMHWIRQAPGQGLEWMGWINPYSGVTNYAQKFQGWVTVTRDTSVSTVYMELRKLRSDDTAVYYCARGYTVIPSALDFDILKGHHWYFDLWGRGTLVTVSSASTKGPSVFPLAPSSKSTSGGTA

SEQ ID NO: 794808 - protein, 179 aa, Homo sapiens
  misc_feature: NA.14.38.D05.1.454.heavy.3.nb-aa
MKHLWFFLLLVAAPRWVLSQVQLRESGPGLVKPSGTLSLTCAVSGGSISSTNWWSWVRQPPGKGLEWIGQIYRSGSTNYNPSLKTRVTISIDTSKNQFSLKLSSVTAADTAVYYCARTIGATLFGVNGWFDPWGQGTQVTVSSASTKGPSVFPLAPSSKSTSGGTAALGCLVKDYFRTR

SEQ ID NO: 794809 - protein, 178 aa, Homo sapiens
  misc_feature: NA.40.20.B09.1.454.heavy.3.nb-aa
MELGLRWVFLVAILEGVKCEVRLVESGGGLVKPGGSLRLSCAASGLTFRSFSMNWVRQAPGKGLEWVSSISSGSTYIHYADSVKGRFTISRDNAGNSLYLQMKSLRAEDTGVYYCTKGQEGLWEYYYGMDVWGQGTAVTVSSASTKGPSVFPLAPCSRSTSGGTAALGCLVKDYFQSL

SEQ ID NO: 794810 - protein, 170 aa, Homo sapiens
  misc_feature: NA.7.78.H01.1.454.heavy.3.nb-aa
MDWTWRILFLVAVATGAHSQVQLVQSGSELRKPGASVSVACKPSGYIFTTYSVNWVRQAPGQGLDYMGWINTDTGNPTYAQAFTGRFVFSMDTSVGTAYLQITNLQPDDTAVYFCTRASSVSGIDYWGQGTLVTVSSASTKGPSVFPWHPPPRAPLGAQRPWAAWSRTTS

SEQ ID NO: 794811 - protein, 179 aa, Homo sapiens
  misc_feature: NA.14.57.F02.1.454.heavy.3.nb-aa
MEFGLSWLFLVAILKDVQCEVQLLESGGGLVQPGGSLTLSCAASGFIFSEYAMSWVRQAPGKGLEWVSAISGSSGSTFDAVSVKGRFSISRDNSKNTLFLQMDSLKDEDTGVYFCVKDTKSMIPNLGGAFHVWGQGTLVTVSSASTKGPSVFPWHPPPRAPLGAQRPWAAWSRTTSVLD

SEQ ID NO: 794812 - protein, 179 aa, Homo sapiens
  misc_feature: NA.16.80.H03.1.454.heavy.3.nb-aa
IMEFWLSWVLLVAILKDVQCEVQLVESGGGLVQPGGSLRLSCSASGFIFSGFAMHWVRQAPGKGLEYVSAISYNGGNTYYADSVKGRFTISRDNSQNTLDLQMSSLRAEDTAVYYCVKDFRGYYDYYYGMDVWGQGTTVTVSSASTKGPSVFPLAPSSKSTSGGTAALGCLVKDYFRVV

SEQ ID NO: 794813 - protein, 176 aa, Homo sapiens
  misc_feature: NA.11.27.C05.1.454.heavy.3.nb-aa
MELGLRWVFLVAILEGVQCEVQLVESGGGLVKPGGSLRLSCAASGFTFSSYSMNWVRQAPGKGLEWVSSISSNSAYRYYADSLKGRLTISRDNAKNSLYLQMNSLRAEDTAVYYCARGAIIWNPDAFDFWGQGTMLTVSSASTKGPSVFPLAPSSKSTSGGTAALGCLVKDYFRIS

SEQ ID NO: 794814 - protein, 173 aa, Homo sapiens
  misc_feature: NA.49.39.D06.1.454.heavy.3.nb-aa
MEFGLSWVFLVALLRGVQCQVQLVESGGGVVQPGRSLRLSCAASGFTFSSYAMHWFRQAPGKGLEWVAVISYDGSDKYYADSVKGRVTISRHNSKNTVFLLVNSLRTEDTAVYYCAAGNDYYPKDYWGQGTLVTVSSASTKGPSVFPLAPSSKSTSGGTAALGCLVKDYFLSR

SEQ ID NO: 794815 - protein, 182 aa, Homo sapiens
  misc_feature: NA.9.34.D01.1.454.heavy.3.nb-aa
MEFGLTWLFLVAVLKGVQCEVQLLESGGGLVQPGESLRLSCVASGFTFETYALTWVRQAPGEGLEWVAGIAGGGHDTFYANSVRGRFIISRDNSQNILSLQLNNLRGEDTAIYFCAKEAYGKYDFRSLRSRHFDYWGRGTLVAVSSASTKGPSVFPWHPPPRAPLGAQRPWAAWSRTTSRRI

SEQ ID NO: 794816 - protein, 173 aa, Homo sapiens
  misc_feature: NA.14.26.C04.1.454.heavy.3.nb-aa
MELGLSWVFLVAILEGVQCEVQLVDSGGGLVQPGGSLRLSCAASGFTFSKYWMMWVRQAPGKGLEWVAHINEDGIKKYYLDSVKGRFTISRDNAENSLYLQMNSLRAEDTAVYYCTRDVGFKTFDYWGQGTLVTVSSASTKGPSVFPLAPCSRSTSESTAALGCLVKDYFRTR

SEQ ID NO: 794817 - protein, 175 aa, Homo sapiens
  misc_feature: NA.5.23.C01.1.454.heavy.3.nb-aa
MKHLWFLLLLVAAPRWALSQVQLQESGPGLVKPSGTLSLTCDVSRGSISTINWWTWVRQPPGKRLEWIGEIYHTGSTNYNPSLKSRVTISIDTSNNQFSLKVTSVTAADTAVYYCARISEGQDYYIDVWGRGTTVIVSSASTKGPSVFPLAPSSKSTSGGTAALGCLVKDYFPCL

SEQ ID NO: 794818 - protein, 180 aa, Homo sapiens
  misc_feature: NA.14.60.F05.1.454.heavy.3.nb-aa
MEFGLSWVFLVAILKGVQCEVQLVESGGGLVQPGGSLKLSCAASGFTFSDSAMHWVRQASGKGLEWVGRIKSKANNYATVYAASVKGRFTISRDDSENTAYLQMNSLKTEDTAVYYCTRPSYDILTGRRGFDPWGQGTLVTVSSASTKGPSVFPLAPCSRSTSGGTAALGCLVKDYFRTR

SEQ ID NO: 794819 - protein, 170 aa, Homo sapiens
  misc_feature: NA.17.33.C11.1.454.heavy.3.nb-aa
MDTLCSTLLLLTIPSWVLSQITLKESGPTLVKPTQTLTLTCTFSGFSLRTSGMGVGWIRQPPGKALEWLALIYWDESKHYSPSLKNRLTITKDTSTNQVVLTMTNMDPVDTATYYCSRSMVRGVISPYFDYWGQGTLVTVSAASTKGPSVFPWHPPPRAPLGAQRPWAAW

SEQ ID NO: 794820 - protein, 167 aa, Homo sapiens
  misc_feature: NA.2.16.B05.1.454.heavy.3.nb-aa
MELGLSWVFLVAILEGVQCEVQLVESGGGLVQPGGSLRLSCAASGFISTNYWMSWVRQAPGKGLEWVASMNGDGSQKNYVDSVKGRFTISRDNAKNSLYLQMNSLRPEDTAVYYCARDRYWGPGALVTVSSASTKGPSVFPLAPCSRSTSESTAALGCLVKDYFLSS

SEQ ID NO: 794821 - protein, 173 aa, Homo sapiens
  misc_feature: NA.13.4.A04.1.454.heavy.3.nb-aa
MEFGLSWLFLVAILKGVQCEVQLVESGGGLVQPGRSLRLSCAASGFTFSNYAMSWVRQAPGKGLEWVSTISASGATTYYADSVKGRFTISRDNSKNTLYLQMNSLRAEDTAVYYCAKEIYPYTFDYWGQGTLVTVSSASTKGPSVFPLAPSSKSTSGGTAALGCLVKDYFRTR

SEQ ID NO: 794822 - protein, 184 aa, Homo sapiens
  misc_feature: NA.9.37.D04.1.454.heavy.3.nb-aa
MESGLSWLLLVAILKGVQCEVHLLESGGALVQPGGSLTLSCTASGFTFNTYALSWVRQAPGKGLDWVAAISGNGENTYYADSVKGRFTISRDNFKNTLYLQMNSLRAEDTAVYHCAKDQKDGSGSYKYYYFYYGMDVWGRGTTVTVSSASTKGPSVFPWHPPPRAPLGAQRPWAAWSRTTSRRI

SEQ ID NO: 794823 - protein, 168 aa, Homo sapiens
  misc_feature: NA.15.28.C06.1.454.heavy.3.nb-aa
MELGLSWVFLVAILEGVQCEVQLVESGGGLVQPGGSLRLSCEASGFTLSTYWMTWVRQAPGKGLEWVATIQKDGSDTTYVNSVMGRFTVSRDDAKNSLHLQMNNLRAEDTAVYYCVRDVLRWGQGTLVTVSSASTKGPSVFPLAPCSRSTSESTAALGCLVKDYFRYV

SEQ ID NO: 794824 - protein, 150 aa, Homo sapiens
  misc_feature: NA.2.4.A04.1.454.heavy.3.nb-aa
MDLMCKKMKHLWFFLLLVAAPRWVLSQLQLQESGPGLVKPSETLSLTCTVSGASISSSSYYWGWIRQPPGKGLEWIGSFYYGGGTYYNPSLKSRVTVSLDTSKNQFSLKLNSMTAADTAVYYCTGRVTLDYWGQGAVVTVSSASTKGPSV

SEQ ID NO: 794825 - protein, 174 aa, Homo sapiens
  misc_feature: NA.4.28.C06.1.454.heavy.3.nb-aa
MEFGLSWVFLVAILKGVQCEVLLVESGGGLVQPGTSLRLSCAASGFTFSSYWLHWVRQAPGKGLVWVSRIDSDGSTRGYADAVRGRFTIFRDNAKDTLYLEMSSLRAEDTAVYYCARDNGLGTPFDYWGPGTLVTVSSASTKGPSVFPWRPAPGAPPRAQRPWAAWSRTTSLQC

SEQ ID NO: 794826 - protein, 152 aa, Homo sapiens
  misc_feature: NA.4.33.C11.1.454.heavy.3.nb-aa
MEFGLSWVFLVAILKGVQCEVQLVESGGGLVQPGRSLRLSCTASGFNFRDYAMNWVRQAPGKGLEWVGFIRAMAYAGTTEYAASVKGRFIISRDDSNGIAYLQMNSLKTEDTAVYYCVREFYDFWSGYYNPHFDYWGQGTLVAVSSASTKGP

SEQ ID NO: 794827 - protein, 182 aa, Homo sapiens
  misc_feature: NA.53.8.A08.1.454.heavy.3.nb-aa
MEFGLSWVFLVALLRGVHCQVQLVESGGSVVRPGRSLRLSCTASGFSFENYGLHWVRQAPGKGLEWVAVISYDSSIGYYADSVKGRFTISRDNSKNTLYLQLSRLTAEDTAVYYCVKDVYESSGFSEYAHYGMDVWGQGTPVTVSLASTKGPSVFPLAPSSKSTSGGTAALGCLVKDYFLVL

SEQ ID NO: 794828 - protein, 171 aa, Homo sapiens
  misc_feature: NA.3.67.G01.1.454.heavy.3.nb-aa
MDFGLRWIFLAAILKGFHCELRLVASGGGLVQPGGSLRLSCAISEAPSNTVWMNWVRQAPGKGLEWVGHIKSKTAGETTDYAAAFRGRFTIFRDESQSTLFLQMNSLEDADTAMYYCTLGHYSPWGQGTLVTVSSASTKGPSVFPLAPCSRSTSESTAALGCLVKDYFRVR

SEQ ID NO: 794829 - protein, 174 aa, Homo sapiens
  misc_feature: NA.40.37.D04.1.454.heavy.3.nb-aa
MEFGLSWLFLVAILKGVQCEVQLLESGGGLVQPGGSLRLSCAASGFTFSNYAMTWVRQTPGTGLEWVSSIGGGGIDTHYADSVKGRFTISRDNSRNTLYLQMNGLTAEDTAKYYCVKDQEVGAGRPQYWGRGILVTVSSASTKGPSVFPWRPAPGAPPRAQRPWAAWSRTTSSR

SEQ ID NO: 794830 - protein, 181 aa, Homo sapiens
  misc_feature: NA.49.25.C03.1.454.heavy.3.nb-aa
MEFGLSWLFLVATLKGVQCDVQLVESGGGLVQPGGSLRLSCVASEFTFRVYAMSWVRQAPGKGLEWVSGISGNDGNTNYADSVKGRFTISRDNSKNMLFLQMNSLRIEDTAVYYCVKEDGPLDEEPYGGSYFDYWGRGTLVTVSSASTKGPSVFPLAPSSKSTSGGTAALGCLVKDYFLSR

SEQ ID NO: 794831 - protein, 172 aa, Homo sapiens
  misc_feature: NA.3.39.D06.1.454.heavy.3.nb-aa
MEFWLSWVFLVAFSKGVQCEVQMVETGGGLIQPGGSLRLSCTGSEFSVTKYYMSWVRQAPGRGLDWVSSVNSDGSTYYADSVKGRFTISRDNSKNTLYLQMNSLRAEDTAFYYCASDHGRSLILSWGQGTLVTVSSASTKGPSVFPWRPAPGAPPRAQRPWAAWSRTTSECV

SEQ ID NO: 794832 - protein, 182 aa, Homo sapiens
  misc_feature: NA.4.26.C04.1.454.heavy.3.nb-aa
MEFGLSWLFLVAILKGVQCEVQLVESGGGLVQPGGSLRLSCTDSGFTFSSHAMSWVRQAPGKGLEWVSAISGGGGGGTYYANSVRGRFTISRDNSKNTLYLQMNSLRADDTAVYYCAKCLIATERSSGWCNWLDPWGQGTHVTVSSASTKGPSVFPWRPAPGAPPRTQRPWAAWSRTTSLQC

SEQ ID NO: 794833 - protein, 156 aa, Homo sapiens
  misc_feature: NA.43.29.C07.1.454.heavy.3.zerom50-aa
MDLLHKNMKHLWFFLLLVAAPRWVLSQVQLQQWGAGLLKPSETLSLTCAVYGGSFSGYYWSWIRQSPGKGLEWIGEVNHRGSTNYNPSLKSRVNIAVDTSKNQFSLKLSSVTVADTAVYYCASSGWYRGYWGQGTLVTVSSASTKGPSVLPLGRPA

SEQ ID NO: 794834 - protein, 144 aa, Homo sapiens
  misc_feature: NA.3.6.A06.1.454.heavy.3.zerom50-aa
MKHLWFFLLLVAAPRCVLSQVHLQESGPGLVTPSETLSLTCTVSGGSISRFYYYWSWIRQSPGKGLEWVGHMHHSGSTNYNPSLESRVTISIDTSKNQFSLSLKSVNAADTAVYYCASTAGKDPFDIWGQGTMVTVSSASTKGP

SEQ ID NO: 794835 - protein, 162 aa, Homo sapiens
  misc_feature: NA.13.64.F09.1.454.heavy.3.zerom50-aa
MDLLCKKMEHLWFFLLLVAAPRWVLAQVQLVESGPGLVKPSTTLSLTCTVSGGSIKTSSYHWGWIRQPPGKELEWMGRIYYTGNTYDNPSLKSRVTLSVDTPNNQFSLKVTSVTVADTAIYYCVRYDFWNGYDSIDYWGPGILVTVSSASTKGPSVFPLATL

SEQ ID NO: 794836 - protein, 173 aa, Homo sapiens
  misc_feature: NA.17.16.B05.1.454.heavy.3.zerom50-aa
MELGLNWVFLVAVLEGVQCEVQLVESGGGLVQPGGSLRLSCAASGFPFSSYWMTWVRQTPGKGLEWVANIKQDGTAEFYVDSVKGRFTISRDNAKNSLYLQLNSLRVADTAVYYCARCGKSNGCVYWGQGALVTVSSASTKGPSVFPWRPAPGAPPRAQRPWAAWSRTTSLVY

SEQ ID NO: 794837 - protein, 173 aa, Homo sapiens
  misc_feature: NA.7.14.B03.1.454.heavy.3.zerom50-aa
MDWTWRILFLVAVATGAHSQVQLVQSGSELRKPGASVSVACKPSGYIFTTYSVNWVRQAPGQGLDYMGWINTDTGNPTYAQAFTVGFVFSMDTSVGTAYLQITNLQPDDTAVYFCTRASSVSGIDYWGQGTLVTVSSASTKGPSVFPLAPSSKSTSGGTAALGCLVKDYFLET

SEQ ID NO: 794838 - protein, 149 aa, Homo sapiens
  misc_feature: NA.9.28.C06.1.454.heavy.3.zerom50-aa
MDTLCSTLLLLTIPSWVLSQITLKESGPTLVKPTQTLTLTCTFSGFSLTTNGVGVGWIRHPPGKALEWLAFVYWNDDKRYSPSLRTRLTITKDTSKNQVVLTMTNMDPVDTATYYCAHSVMTAVTVLPFGYWGQGTLVTVSSASTKGPT

SEQ ID NO: 794839 - protein, 179 aa, Homo sapiens
  misc_feature: NA.9.38.D05.1.454.heavy.3.zerom50-aa
MDTLCSTLLLLTIPSWVLSQITLKESGPTLVKPTQTLTLTCTFSGFSLNSSGVGVGWFRQPPGKALEWVALIYWDDGYRYSPSLRRRLTITKDTPKNQVVLTMTTMDPVDTATYFCAHSIGAPGSLPNWFDPWGPGTLVTVSSASTKGPSVFPLAPCSRSTSESTAALGCLVRTTSRRI

SEQ ID NO: 794840 - protein, 146 aa, Homo sapiens
  misc_feature: NA.52.74.G08.1.454.heavy.3.zerom50-aa
MKHLWFFLLLVTAPRGVLSQVQLQESGPGLMKPSETLSLTCNVSGYSIGSGYYWAWIRQPPGKGLEWIGSIHHSGDNNHNPSLRGRVTFSVETSKNQFSLKLTSLTAADTALYYCARVNTAITYYVEYWGQGTPVTISSASTKGPI

SEQ ID NO: 794841 - protein, 185 aa, Homo sapiens
  misc_feature: NA.51.49.E05.1.454.heavy.3.zerom50-aa
MDLLDKNMKPLWFFLLLVAAPRWVLSQVQLQQRGARLLKPLETLSLTCTLSGATFSGYFWGWVRQPPGKGLQWIGEISRSGETFYNPSLKSRVAISTDASKSEVSLTLRSVTAADAAVYYCARVPAGFWSGYYAGMDVWGAGTTVAVSSASTKGPSVFPLAPSSKSTSGGTAALGCLVKDYFLVA

SEQ ID NO: 794842 - protein, 127 aa, Homo sapiens
  misc_feature: NA.40.61.F06.1.454.heavy.3.zerom50-aa
MEFGLSWVFLVAILKGVQCEVHLVEWVSAINWNGGSGHYADSVRGRFTISRDNAKNSLYLQMNSLKVEDTAFYYCVRDGMWHLSLHTNWGQGTLVTVSSASTKGPSVLPLATLLQEHLWGHSGPGLP

SEQ ID NO: 794843 - protein, 159 aa, Homo sapiens
  misc_feature: NA.51.58.F03.1.454.heavy.3.zerom50-aa
GDLMCKKMKHLWFFLLLVAAPRWVLSQLQLQESGPGLVKPSETLSLTCTVSGGSISSSSYFWGWIRQPPGKGLEWIGNVHYSGSTYYNPSLNSRVTISVDTSKNQFFLRLTSVTAADTAVYYCARKNYLENWGHGTLVTVSSASTKGPSVLPPGHPPPR

SEQ ID NO: 794844 - protein, 169 aa, Homo sapiens
  misc_feature: NA.49.70.G04.1.454.heavy.3.zerom50-aa
MEFGLSWVFLVAIIKGVQCEVQLVQSGGGLVQPGISLRLSCAASGVTVSNNYMSWVRQAPGKGLEWVSLIYSGGNTRYADSVRGRFTISRDSSKNTLYLQMNSLRPDDTAVYYCAVFTSLEYWGQGSLVIVSSASTKGPSVFPLAPCSRSTSESTAALGCLVKDYFLSR

SEQ ID NO: 794845 - protein, 170 aa, Homo sapiens
  misc_feature: NA.40.34.D01.1.454.heavy.3.multim50-aa
MGATAILALLLAVVQGVCAEVQLVQSGAEVKKPGESLKISCLGLGYNFTIYWIAWVRQMPGKGLEWVGIVYPDDSDTRYSPSFQGQVTISADKSVNTAYLQWSSLQASDTAMYFCARGFGDDYWGQGTLVTVSSASTKGPSVFPLAPCSRSTSGGTAALGCLVKDYFQSL

SEQ ID NO: 794846 - protein, 156 aa, Homo sapiens
  misc_feature: NA.12.40.D07.1.454.heavy.3.multim50-aa
MEFGLSWVFLVALLRGVQCQGHLVESGGAVVQPGRSLTLACVASGFPFNFYSMHWVRQAPGKGLEWVALIAHDGVNKFYANSVRGRFTISRDNYKNTLYLQIDSLRPDDTAVYYCARETHEPTGQYYGGLFWGQGTLVIVSPASTKGPSVFPLAAL

SEQ ID NO: 794847 - protein, 164 aa, Homo sapiens
  misc_feature: NA.51.26.C04.1.454.heavy.3.multim50-aa
MEFGLSWVFLVALLRGVQCQVHLVESGGGVVQPGRSLRLSCAASGFTFDNFNMHWVRRAPGKGLEWVAVITSDGGTTYYSDAVRGRFTISRDNSGNTLSLQMNSLRAEDRAVYYCVRSDLTGTGSYFLRNGMDVWGQGTTVTVSLASTKGPSVFPLATLLQEHL

SEQ ID NO: 794848 - protein, 178 aa, Homo sapiens
  misc_feature: NA.48.67.G01.3.454.heavy.3.multim50-aa
  MOD_RES (169)..(169): Any amino acid
MEFGLNWVFLVALLRDVQCRVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPAPEHLREHSGPGXPGQGLLPMY

SEQ ID NO: 794849 - protein, 176 aa, Homo sapiens
  misc_feature: NA.48.78.H01.5.454.heavy.3.multim50-aa
  MOD_RES (126)..(126): Any amino acid
MEVGLCWVFLVAILEGVQCEVQLVESGGALVPPGGSLRLSCVASGFTFSSHSMVWVRQAPGKGLEWISYIRSGSSPIYYADSVKGRFIISRDNAENSLFLQMNSLRDEDTAVYYCARVRISPTQGXFDPWGQGTLVTVSSASTKGPSVFPWHPPPRAPLGAQRPWAAWSRTTSYVY

SEQ ID NO: 794850 - protein, 181 aa, Homo sapiens
  misc_feature: NA.48.37.D04.5.454.heavy.3.multim50-aa
  MOD_RES (20)..(20): Any amino acid
  MOD_RES (24)..(25): Any amino acid
MEFGLSVGFPCCYFKRCPVXGLGXXVAGGLVQPGGSLKLSCTASGFAFTASGFSFSASAMHWVRQASGRGLEWVGRIRTKPNNYATAFAASVRGRFTLLRDDSKNTAYLQMDNLKTEDTAVYYCTSEVTGTAGYWGQGTLVAVSSASTKGPSVFPWRPAPGAPPRAQRPSGCLVKDYFLCI

SEQ ID NO: 794851 - protein, 152 aa, Homo sapiens
  misc_feature: NA.48.28.C06.7.454.heavy.3.multim50-aa
MDTLCSTLLLLTIPSWVLSQITLKESGPTLVKPTQTLTLTCTFSGFSLTTDEVGVAWIRQPPGKAPEWLGLIYGDGDKRYSASLKTRLSITKDTSKNEVVLSLANMHPVDTATYFCTHTILTTGDAFHFWGQGTVVAVSTASTKGPSVLPPG

SEQ ID NO: 794852 - protein, 190 aa, Homo sapiens
  misc_feature: NA.53.68.G02.1.454.heavy.3.multim50-aa
MDLLHKNMKHLWFFLLLVAAPRWVLSQVQLQQWGSGLLKPSETLSLTCAVYGGSFSDYYWTWIRQAPGKGLEWIAEINHSGKTTYNPSLKSRVTLSVDTPKKQFSLRVTSVTAADTAVYYCARGPLVSVFGLVLPWNPYFEYWGRGALVTVSSASTKGPSVFPLATLLQEHLWGHSGPGLPGQGLLPRTA

SEQ ID NO: 794853 - protein, 163 aa, Homo sapiens
  misc_feature: NA.49.78.H01.4.454.heavy.3.multim50-aa
MEFGLSWVFLVAILKGVQCDVQVVESGGGLVQPGGSLTLSCIVSGFTVSNNYMSWVRQAPGKGLEWVSVIYSGGDTYYADSVKGRFTISRDGFKNTLYLQMNSLRAEDTAVYYCARDPPGIAVSGTYYWGQGTLVTVSSASTKGPSVFPWRPAPGAPPRAQRP

SEQ ID NO: 794854 - protein, 182 aa, Homo sapiens
  misc_feature: NA.52.33.C11.6.454.heavy.3.multim50-aa
MELGLSWIFLLAILKGVQCEVQLVESGGGVVQPGGSLRLSCAASGFSFDEYAMHWVRQAPGKGLEWVSGISWTSGSIGYGASVKGRFTISRDNAKNSLSLQMNGLRVEDTGFYYCAKGPALFYDITAYYYTPVDSWGQGTLVTVSSASTKGPSVFPWHPPPRAPLGAQRPWAAWSRTTSYTI

SEQ ID NO: 794855 - protein, 184 aa, Homo sapiens; identical to SEQ ID NO: 794780
  misc_feature: NA.48.23.C01.1.454.heavy.3.multim50-aa

SEQ ID NO: 794856 - protein, 180 aa, Homo sapiens
  misc_feature: NA.40.57.F02.1.454.heavy.3.multim50-aa
MDFGLRWLFLVALLKGVQCEVQLLESGGGLIQPGGSLRLACTASGLTFRNDALSWVRQAAGKGLEWVSIISGRTDSRNYADSVKGRFTISRDVSNNTIFLEMNSLRAEDTAKYYCAKRTLYCSGGSCNYYFDSWGQGTLVTVSSASTKGPSVFPLAPSSKSTSGGTAALGCLVKDYFQSL

SEQ ID NO: 794857 - protein, 178 aa, Homo sapiens
  misc_feature: NA.53.78.H01.1.454.heavy.3.multim50-aa
MDWTWRFLFVVAAVTGLNSQVQLVQSGAELKKPGSSVKVSCKYSGGTFNNYGISWVRQAPGQGLEWMGRVTPIFDEADSAQKFQGRLTITADKSTTTAYMELTSLKSEDTALYYCARYTVGVTAEISPYYFDYWGQGTLITVSSASTKGPSVFPLATLLQEHLWGHSGPGLPGQGLLP

SEQ ID NO: 794858 - protein, 174 aa, Homo sapiens
  misc_feature: NA.52.35.D02.3.454.heavy.3.multim50-aa
  MOD_RES (26)..(26): Any amino acid
MEFGLSWVFLVAILKGVQCGVQVVGXGGGLVQPGGSLRLSCAASGFSVSSNYMSWVRQAPGKGLEWVSSLYVGGTTYYADSVKGRFTISRDESRNSLFLQMDSLRPDDTAVYYCAREPRGREQPRNFWGQGTRVTVSSASTKGPSVFPLAPSSKSTSGGTAALGCLVKDYFLYD

SEQ ID NO: 794859 - protein, 167 aa, Homo sapiens
  misc_feature: NA.52.35.D02.6.454.heavy.3.multim50-aa
  MOD_RES (162)..(162): Any amino acid
IGFGLSVALYVVAILKGVQCDVQLVESGGAFQHPGGSLRLTCEASGFRFSSHAMTWVRQAPGQGLEWVSGISGTGDTTYYADSVKGRFTISRDSSKNTLYLQMNSLRVEDTAVYYCAKDRGRMTVFGVAKDGRFRYGLDVWGQGTTVTVASASTKGPSVFPXAPSSK

SEQ ID NO: 794860 - protein, 181 aa, Homo sapiens
  misc_feature: NA.48.29.C07.2.454.heavy.3.multim50-aa
MEFGLSWVFLVAILKGVQCEVQLVQSEGGLVQPGGSLKLSCTASGFAFTASGFSFSASAMHWVRQASGRGLEWVGRIRTKPNNYATAFAASVRGRFTLLRDDSKNTAYLQMDNLKTEDTAVYYCTSEVTGTAGYWGQGTLVAVSSASTKGPSVFPWRPAPGAPPRAQRPWAAWSRTTSYVY

SEQ ID NO: 794861 - protein, 177 aa, Homo sapiens
  misc_feature: NA.48.29.C07.6.454.heavy.3.multim50-aa
  MOD_RES (62)..(62): Any amino acid
  MOD_RES (127)..(127): Any amino acid
MELGLRWVILVAILEGVQCEVQLVESGGRPGQAWGVPETLLCSLWIHLQYLYHELGPPGSRXGLEWVSSISSSSNYIDDADSVKGRFTISRDNAKHSLYLQMNSLRADDTAVYYCARLGREWDLLFXFDYWGQGTLVTVSSASTKGPSVFPLAPSSKSTSGAQRPWAAWSRTTSYVY

SEQ ID NO: 794862 - protein, 164 aa, Homo sapiens
  misc_feature: NA.49.37.D04.2.454.heavy.3.multim50-aa
IGFGLSWVFLVAILKGVQCDVQVVESGGGLVQPGGSLTLSCIVSGFTVSNNYMSWVRQAPGKGLEWVSVIYSGGDTYYADSVKGRFTISRDGFKNTLYLQMNSLRAEDTAVYYCARDPPGIAVSGTYYWGQGTLVTVSSASTKGPSVLPLAALASTEPPPRRTA

SEQ ID NO: 794863 - protein, 180 aa, Homo sapiens
  misc_feature: NA.51.77.G11.1.454.heavy.3.multim50-aa
MEFGLTWVFLVALLRGVQCQVQLVESGGGVVQPGRSLRLSCAASGFTFRVYDMHWVRQAPGKGLEWVAVISYDGSKIFYVDSVKGRFIISRDNSQNTLFLQMHSLRPEDTAVYYCANLITEDNGDPRPLGAEVWGQGTTVIVSSASTKGPSVFPLAPSSKSTSGGTAALGCLVKDYFLVA

SEQ ID NO: 794864 - protein, 183 aa, Homo sapiens
  misc_feature: NA.52.37.D04.3.454.heavy.3.multim50-aa
  MOD_RES (26)..(26): Any amino acid
  MOD_RES (183)..(183): Any amino acid
MELGLSWVFLVAILEGVQCEAQLVGXGGGLVQPGGSLTLSCVASGFTFNSYWMTWVRQAPGKGLEWVASVKHDGGEEDYADSVKGRFTTSRDNIKNSMYLQMSSLTSEDTAVYYCARVLWDVVVAPAALPGCYFDLWGRGTLVTVFSASTKGPSVFPLAPSSKSTSGGTAALGCLVKDYFLYX

SEQ ID NO: 794865 - protein, 174 aa, Homo sapiens
  misc_feature: NA.52.34.D01.2.454.heavy.3.multim50-aa
MEFGLSWVFLVAILKGVQCGVQVVGFGGGLVQPGGSLRLSCAASGFSVSSNYMSWVRQAPGKGLEWVSSLYVGGTTYYADSVKGRFTISRDESRNSLFLQMDSLRPDDTAVYYCAREPRGREQPRNFWGQGTRVTVSSASTKGPSVFPLAPSSKSTSGGTAALGCLVKDYFLYD

SEQ ID NO: 794866 - protein, 180 aa, Homo sapiens
  misc_feature: NA.48.27.C05.3.454.heavy.3.multim50-aa
MEFGLNWVFLVALLRDVQCRVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPLGRPAPGAPPRAQRPSGCLVKDYFLCI

SEQ ID NO: 794867 - protein, 181 aa, Homo sapiens; identical to SEQ ID NO: 794860
  misc_feature: NA.48.27.C05.5.454.heavy.3.multim50-aa

SEQ ID NO: 794868 - protein, 177 aa, Homo sapiens; identical to SEQ ID NO: 794754
  misc_feature: NA.48.24.C02.2.454.heavy.3.multim50-aa

SEQ ID NO: 794869 - protein, 161 aa, Homo sapiens
  misc_feature: NA.49.33.C11.1.454.heavy.3.multim50-aa
IGFGLSWVFLVAILKGVQCDVQVVESGGGLVQPGGSLTLSCIVSGFTVSNNYMSWVRQAPGKGLEWVSVIYSGGDTYYADSVKGRFTISRDGFKNTLYLQMNSLRAEDTAVYYCARDPPGIAVSGTYYWGQGTLVTVSSASTKGPSVFPWRPAPGAPPRAQ

SEQ ID NO: 794870 - protein, 180 aa, Homo sapiens
  misc_feature: NA.49.33.C11.2.454.heavy.3.multim50-aa
  MOD_RES (1)..(1): Any amino acid
XEFGLSWVFLVALLRGVQCHVQLIGFGGGVVQPGRSLRLSCAASGFVSSVYPMHWVRQAPGKGLEWVALISSDGRSESYADSVKGRFTISRDNSKNTLYLQMNTLRREDTAVYYCATEMSYYDASALVPFDPWGQGALVTVSSASTKGPSVFPLAALLQEHLWGHERPWAAWSRTTSSLV

SEQ ID NO: 794871 - protein, 182 aa, Homo sapiens
  misc_feature: NA.49.33.C11.4.454.heavy.3.multim50-aa
  MOD_RES (1)..(2): Any amino acid
  MOD_RES (166)..(166): Any amino acid
XXFGLSWVFLVALLRGVLCRVQLVESGGSVVRPGKSLRLSCTASGFKFENYGLHWVRQAPGKGLEWVAVISYDSSIGYYAESVKGRFTISRDNSKNTMYLELSRVTSEDTAMYYCVKDFYDSSGFSEYAHYGMDVWGQGTPVTVSLASTKGPSVFPLAPSSKSTSXGTAALGCLVKDYFLSR

SEQ ID NO: 794872 - protein, 158 aa, Homo sapiens
  misc_feature: NA.51.30.C08.4.454.heavy.3.multim50-aa
MDLMCKKMKHLWFFLLLVAAPRWVLSQLQLQESGPGLVKPSETLSLTCTVSGGSISSSSYFWGWIRQPPGKGLEWIGNVHYSGSTYYNPSLNSRVTISVDTSKNQFFLRLTSVTAADTAVYYCARKNYLENWGHGTLVTVSSASTKGPSVFPRPPVLQ

SEQ ID NO: 794873 - protein, 179 aa, Homo sapiens
  misc_feature: Description of Unknown: NA.48.33.C11.4.454.heavy.3.multim50-aa
MEFGLNWVFLVALLRDVGCWVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPAPGAPPRAQRPWAAWSRTTSYVY

SEQ ID NO: 794874 - protein, 179 aa, Homo sapiens
  misc_feature: NA.48.37.D04.3.454.heavy.3.multim50-aa
MEFGLNWVFLVALLRDVQCRVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPRSRSTSESTAALGCLVKDYFLCI

SEQ ID NO: 794875 - protein, 185 aa, Homo sapiens; identical to SEQ ID NO: 794774
  misc_feature: NA.49.41.D08.6.454.heavy.3.multim50-aa

SEQ ID NO: 794876 - protein, 176 aa, Homo sapiens
  misc_feature: NA.49.57.F02.7.454.heavy.3.multim50-aa
  MOD_RES (156)..(156): Any amino acid
VGFGGKRKTDGPPRSSGAGHRGHGGGVVQPGRSLRLSCAASGFVSSVYPMHWVRQAPGKGLEWVALISSDGRSESYADSVKGRFTISRDNSKNTLYLQMNTLRREDTAVYYCATEMSYYDASALVPFDPWGQGALVTVSSASTKGPSVFPWPPSLXEHLWGHSGPGLPGQGLLPLS

SEQ ID NO: 794877 - protein, 175 aa, Homo sapiens
  misc_feature: NA.49.59.F04.1.454.heavy.3.multim50-aa
MDWTWRFLFVVAAATGVQSQVQLVQSGAEVKKPGSSVKVSCKASGGTLSSYTMNWVRQAPGQGLEWMGRIIPIVGVTNYAQKFQDRITITADTSTSTIFMELSSLRSEDTAVYYCASDPGFPRFEDDYWGQGTLVTVSSASTKGPSVFPLAPSSKSTSGGTAALGCLVNDYFLSR

SEQ ID NO: 794878 - protein, 167 aa, Homo sapiens
  misc_feature: NA.49.59.F04.2.454.heavy.3.multim50-aa
MEFGLSWVFLVALLRGVQCHVQLIQSGGGVVQPGRSLRLSCAASGFVSSVYPMHWVRQAPGKGLEWVALISSDGRSESYADSVKGRFTISRDNSKNTLYLQMNSLRREDTAVYYCATEMSYYDASALVPFDPWGQGALVTVSSASTKGPSVFPWPPCSRSTSGAQRP

SEQ ID NO: 794879 - protein, 175 aa, Homo sapiens
  misc_feature: NA.51.28.C06.3.454.heavy.3.multim50-aa
MELGLSWIFLLAILKGVQCEVLLVESGGGLVQPGRSLRLSCAASGFTFDDYAMHWVRQAPGKGLEWVSRISWNSGSIAYADSVKGRFTISRDNAKNSLYLQMNSLRAEDTALYYCAKAKATAGTQLDYWGQGTLVTVSSASTKGPSVFPWPPSSKSTSGGTAALGCLVKDYFLVA

SEQ ID NO: 794880 - protein, 179 aa, Homo sapiens
  misc_feature: NA.48.34.D01.1.454.heavy.3.multim50-aa
MEFGLNWVFLVALLRDVQCWVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPAPGAPPRAQRPWAAWSRTTSYVY

SEQ ID NO: 794881 - protein, 182 aa, Homo sapiens
  misc_feature: NA.49.78.H01.3.454.heavy.3.multim50-aa
  MOD_RES (154)..(154): Any amino acid
MEFGLSWVFLVALLRGVQCHVQLIQSGGGVVQPGRSLRLSCAASGFVSSVYPMHWVRQAPGKGLEWVALISSDGRSESYADSVKGRFTISRDNSKNTLYLQMNTLRREDTAVYYCATEMSYYDASALVPFDPWGQGALVTVSSASTKGPSVFPXRSALLQERPLGARAALGLPGQGLLPLST

SEQ ID NO: 794882 - protein, 174 aa, Homo sapiens
  misc_feature: NA.40.35.D02.2.454.heavy.3.multim50-aa
MEFGLSWLFLVAILKGVQCEVQLLEFGGGLVQPGGSLRLSCAASGFTFSNYAMTWVRQTPGTGLEWVSSIGGGGIDTHYADSVKGRFTISRDNSRNTLYLQMNGLTAEDTAKYYCVKDQEVGAGRPQYWGRGILVTVSSASTKGPSVFPWRPAPGAPPRVQRPWAAWSRTTSSR

SEQ ID NO: 794883 - protein, 181 aa, Homo sapiens
  misc_feature: NA.49.35.D02.1.454.heavy.3.multim50-aa
MEFGLSWVFLVALLRGVQCHVQLIQSGGGVVQPGRSLRLSCAASGFVSSVYPMHWVRQAPGKGLEWVALISSDGRSESYADSVKGRFTISRDNSKNTLYLQMNTLRREDTAVYYCATEMSYYDASALVPFDPWGQGALVTVSSASTKGPIRSFPLAALAPRSDLWGHSGPGLPGQGLLPLS

SEQ ID NO: 794884 - protein, 178 aa, Homo sapiens
  misc_feature: NA.52.53.E09.1.454.heavy.3.multim50-aa
MEFGLSWVFLVAILKGVQCGVQVVESGGGLVQPGGSLRLSCAASGFSVSSNYMSWVRQAPGKGLEWVSSLYVGGTTYYADSVKGRFTISRDESRNSLFLQMDSLRPDDTAVYYCAREPRGREQPRNFWGQGTRVTVSSASTKGPSVFPWHPPPRAPLGAQRPWAAWSRTTSYTIGTFT

SEQ ID NO: 794885 - protein, 183 aa, Homo sapiens
  misc_feature: NA.48.70.G04.1.454.heavy.3.multim50-aa
MEFGLSWIFLAAILKGVQCEVQLVQSGGGLVPPGGSLRLSCAASGFIFSNVWMTWFRQAPGKGLEWVGRVKTKAEGGTIDYAAPVTGRFAISRDDSEGTLYLQMNSLKAEDTAVYYCTAGLGYSDTDYWGQGTLVTVSSASTKGPSVFPLAPCSRSTSESTAALGCLVKDYFLCILCGGVDDG

SEQ ID NO: 794886 - protein, 142 aa, Homo sapiens
  misc_feature: NA.13.39.D06.1.454.heavy.3.multim50-aa
MKHLWFFLLLVAAPRWVLSQVQLQESGPGLVRPSQTLSLICSVSGGSFSSGSFYWSWIRQPAGKGLEWIGLINASGGTSYNPSLKSRVTISVDTSKNQLSLKLSSVTAADTAVYYCARQVDVWGQGTTVTVSSASTKGPSVP

SEQ ID NO: 794887 - protein, 156 aa, Homo sapiens
  misc_feature: NA.53.35.D02.2.454.heavy.3.multim50-aa
FGFGLSWVFLVALLRGVQCHVQLVQSGGGVVQPGRSLKLSCAASGFVSSVYPLHWVRQAPGKGLEWVALISSDGRDAYYADSVKGRFTISRDNSKNTLYLQMDSLRAEDTAVYYCASEMSYYDASGLVPFDPWGQGTLVTVSSASTKGPSVFPWRP

SEQ ID NO: 794888 - protein, 178 aa, Homo sapiens
  misc_feature: NA.9.30.C08.1.454.heavy.3.multim50-aa
MKHLWFFLLLVAAPRWVLSQVQLQEKGKGLVKPSQTLSLTCTVSGDSITGTNYYWSWIRQPPGKGLEWIGYAFYSGVTYYNPSLKSRVTISVDTSQNQFSLEVTSVTAADSAVYFCARTQSSAYYTLNFDFWGQGSLVTVSSASTKGPSVFPLAPCSRSTSESTAALGCLVKDYFQTY

SEQ ID NO: 794889 - protein, 183 aa, Homo sapiens; identical to SEQ ID NO: 794783
  misc_feature: NA.52.27.C05.3.454.heavy.3.multim50-aa

SEQ ID NO: 794890 - protein, 184 aa, Homo sapiens
  misc_feature: NA.52.38.D05.3.454.heavy.3.multim50-aa
  MOD_RES (13)..(14): Any amino acid
MELGLSWVFLVAXXDRCSIQCEAQLVESGGGLVQPGGSLTLSCVASGFTFNSYWMTWVRQAPGKGLEWVASVKHDGGEEDYADSVKGRFTTSRDNIKNSMYLQMSSLTSEDTAVYYCARVLWDVVVAPAALPGCYFDLWGRGTLVTVFSASTKGPSVFPWHPPPRAPLGARAALGCLVKDYFLY

SEQ ID NO: 794891 - protein, 161 aa, Homo sapiens
  misc_feature: NA.49.28.C06.5.454.heavy.3.multim50-aa
MEFGLSWVFLVAILKGVQCDVQVVESGGGLVQPGGSLTLSCIVSGFTVSNNYMSWVRQAPGKGLEWVSVIYSGGDTYYADSVKGRFTISRDGFKNTLYLQMNSLRAEDTAVYYCARDPPGIAVSGTYYWGQGTLVTVSSASTKGPSVFPWRPAPGAPPRAQ

SEQ ID NO: 794892 - protein, 178 aa, Homo sapiens
  misc_feature: NA.48.30.C08.2.454.heavy.3.multim50-aa
MELGLSWIFLLTILKGGHCERLQGKGGGGLVQPGRSLKLSCVASGFRLGDYAMQWVRQGPGKGLEWVSGIDWKSEKIDYAESVKGRFIISRDNAKNSLYLQMNNLRPDDTALYYCAKVVESQSLDYGMDVWGQGTTVTVSSASTKGPSVFPLATLLQEHLWGHSGPGLPGQGLLPMYT

SEQ ID NO: 794893 - protein, 180 aa, Homo sapiens
  misc_feature: NA.49.79.H02.1.454.heavy.3.multim50-aa
MEFGLSWVFLVALLRGVQCQVQLVESGGGVVQPGRSLRLSCAASGFTFRVYDMHWVRQAPGKGLEWVAFISYDGSKIYYVDSVKGRFIISRDNSENTLYLQMNRLRAEDTALYYCANLITEDNGDPRPLGAEVWGQGTTVIVSSASTKGPSVFPLAPSSKSTSGAQRPWAAWSRTTSSLD

SEQ ID NO: 794894 - protein, 179 aa, Homo sapiens
  misc_feature: NA.51.30.C08.1.454.heavy.3.multim50-aa
MEFGLSWVFLVALLRGVQCHVQLIQSGGGVVQPGRSLRLSCAASGFVSSVYPMHWVRQAPGKGLEWVALISSDGRSESYADSVKGRFTISRDNSKNTLYLQMNSLRREDTAVYYCATEMSYYDASGLVPFDPWGQGTLVTVSSASTKGPSVFPLAPCSRSTSGGTAALGCLVKDYFLVA

SEQ ID NO: 794895 - protein, 174 aa, Homo sapiens
  misc_feature: NA.52.87.H10.4.454.heavy.3.multim50-aa
MEFGLSWVFLVAILKGVQCGVQVVGFGGGLVQPGGSLRLSCAASGFSVSSNYMSWVRQAPGKGLEWVSSLYVGGTTYYADSVKGRFTISRDESRNSLFLQMDSLRPDDTAVYYCAREPRGREQPRNFWGQGTRVTVSSASTKGPSVFPSAPSSKSTSGGTAALGCLVKDYFLYD

SEQ ID NO: 794896 - protein, 179 aa, Homo sapiens
  misc_feature: NA.48.53.E09.2.454.heavy.3.multim50-aa
  MOD_RES (20)..(20): Any amino acid
MEFGLNWVFLVALLRDVQCXVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPAPGAPPRAQRPWAAWSRTTFLCI

SEQ ID NO: 794897 - protein, 180 aa, Homo sapiens
  misc_feature: NA.48.28.C06.4.454.heavy.3.multim50-aa
MEFGLNWVFLVALLRDVQCRVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSGLPPGRPRLQEHLPRAQRPWAAWSRTTSYV

SEQ ID NO: 794898 - protein, 183 aa, Homo sapiens
  misc_feature: NA.52.33.C11.5.454.heavy.3.multim50-aa
MELGLSWVFLVAILEGVQCEAQLVGFGGGLVQPGGSLTLSCVASGFTFNSYWMTWVRQAPGKGLEWVASVKHDGGEEDYADSVKGRFTTSRDNIKNSMYLQMSSLTSEDTAVYYCARVLWDVVVAPAALPGCYFDLWGRGTLVTVFSASTKGPSVFPWHPPPRAPLGAQRPWAAWSRTTSYTI

SEQ ID NO: 794899 - protein, 179 aa, Homo sapiens
  misc_feature: NA.48.55.E11.1.454.heavy.3.multim50-aa
MEFGLNWVFLVALLRDVQCRVQLVESGGGVVQPGKSLTLSCAASGFTFTTFRMHFVRQAPGKGLEWVAVVSNDGHAEYADSVRGRFAFSRDNSKSTVHLQMSALRPDDTAVYYCARGRPSLTRRREGYYFDNWGQGTLVTVSSASTKGPSVFPWRPAPGAPPRAQRPWAAWSRTTSYVY

SEQ ID NO: 794900 - protein, 153 aa, Homo sapiens
  misc_feature: NA.48.35.D02.1.454.heavy.3.multim50-aa
  MOD_RES (151)..(151): Any amino acid
MDTLCSTLLLLTIPSWVLSQITLKESGPTLVKPTQTLTLTCTFSGFSLTTDEVGVAWIRQPPGKAPEWLGLIYGDGDKRYSASLKTRLSITKDTSKNEVVLSLANMHPVDTATYFCTHTILTTGDAFHFWGQGTVVAVSTASTKGPSVFPXPP

SEQ ID NO: 794901 - protein, 163 aa, Homo sapiens
  misc_feature: NA.51.37.D04.2.454.heavy.3.multim50-aa
IGFGLSWVFLVALLRGVQCQVHLVESGGGVVQPGRSLRLSCAASGFTFDNFNMHWVRRAPGKGLEWVAVITSDGGTTYYSDAVRGRFTISRDNSGNTLSLQMNSLRAEDRAVYYCVRSDLTGTGSYFLRNGMDVWGQGTTVTVSLASTKGPSVFPWPPSSKST

SEQ ID NO: 794902 - protein, 182 aa, Homo sapiens
  misc_feature: NA.49.37.D04.4.454.heavy.3.multim50-aa
MDWTWRVFCLLAVAPGAHSQVQLVGFGVEVKKPGASVKVSCKASGYSLTNYYIQWVRQAPGQGLEWMGRINPNDGSTTNAQKFQGRITLTRDTSTSTVYMELSSLRSEDTAVYYCAREYRFIVGAAPRSPFHFDYWGQGTLVTVSSASTKGPSVFPWPPSSKSTSGGTAALGCLVKDYFLSR

SEQ ID NO: 794903 - protein, 163 aa, Homo sapiens
  misc_feature: NA.51.34.D01.3.454.heavy.3.multim50-aa
IGFGLSWVFLVALLRGVQCQVHLVESGGGVVQPGRSLRLSCAASGFTFDNFNMHWVRRAPGKGLEWVAVITSDGGTTYYSDAVRGRFTISRDNSGNTLSLQMNSLRAEDRAVYYCVRSDLTGTGSYFLRNGMDVWGQGTTVTVSLASTKGPSVFPWHPPPRAP

SEQ ID NO: 794904 - protein, 179 aa, Homo sapiens; identical to SEQ ID NO: 794899
  misc_feature: NA.48.38.D05.1.454.heavy.3.multim50-aa

SEQ ID NO: 794905 - protein, 178 aa, Homo sapiens
  misc_feature: NA.52.34.D01.1.454.heavy.3.multim50-aa
MEFGLSWLFLVAILKGVQCEVQLLEFGGGLVKRGGYLRLSCSVSGFTLNNYGMSWVRQAPGKGLEWVSFISGTGGSTYYADSVKGRFTISKDNSKNTLYLQMNSLRAEDTAVYYCVKDLHVSPPWTGYFDSWGQGTLVAVSSASTKGPSVFPLAPSSKSTSGGTAALGCLVKDYFLYD

SEQ ID NO: 794906 - protein, 135 aa, Homo sapiens
  misc_feature: NA.14.11.A11.1.454.light.4.nb-aa
MDMRVPAQLLGLLLLWLPGARCAIQVTQSPSSLSASVGDRVTITCRASQFIRNELGWYQQKPGKAPKLLIYAASNLQTGVPSRFSGSGSGTDFTLTISSLQPEDFATYYCLQDYNYPRTFGQGTKVEVKRTVAAP

SEQ ID NO: 794907 - protein, 140 aa, Homo sapiens
  misc_feature: NA.14.3.A03.1.454.light.4.nb-aa
MAWALLLLTLLTQGTGSWAQSALTQPASVSGSPGQSITISCTGTSSDVGYYNFVSWYQQHPGKAPKLIIYEVNNRPSGVSNRFSGSKSGNTASLSISGLQAEDEADYYCSSYTISRTVVFGGGTKVTVLGQPKAAPSVTL

SEQ ID NO: 794908 - protein, 137 aa, Homo sapiens
  misc_feature: NA.14.30.C08.1.454.light.4.nb-aa
VDMRVPAQLLGLLLLWLRGARCDIQMTQSPSSLSASVGDRISITCRASQAIDTLLNWYQQKPGKAPKLLIYDATNLQDGIPSRFSGGGSGADFTLTISSLQPEDFATYWCQQGYHNPYTFGQGTKLDIIRTVAAPSV

SEQ ID NO: 794909 - protein, 147 aa, Homo sapiens
  misc_feature: NA.14.33.C11.1.454.light.4.nb-aa
WVWALLLLTLLTQGTGSWAQSALTQPASVSGSPGQSITISCTGTNIDVGDYNFVSWYQQHPGKAPKLIIYEVSKRPSGVSNRFSGSKSGNTASLTVSGLQTEDEADYYCHSYRSSTTPVVFGGGTKLTVLGQPKAAPSVTLFPPSSY

SEQ ID NO: 794910 - protein, 139 aa, Homo sapiens
  misc_feature: NA.14.35.D02.1.454.light.4.nb-aa
MVLQTQVFISLLLWISGAYGDIVMTQSPDSLAVSLGERATINCKSSQSVLYSSNNKNYLAWYQQKPGQSPKLLIFWASTRESGVPERFSGSGSGTDFTFTISSLQAEDVAVYYCQQYYSTPYTFGQGTKLEIKRTVAAP

SEQ ID NO: 794911 - protein, 145 aa, Homo sapiens
  misc_feature: NA.14.5.A05.1.454.light.4.nb-aa
MEAPAQLLFLLLLWLPDTTGEIVLTQSPGTLSLSPGERATLSCRASQSVDTYLAWYQQKPGQAPRLLIYDASIRATGIPARFSGSGSGTDFTLTISSLEPEDFAVYYCQQRTNWPPALTFGGGTKVEIKRTVAAPSVFIFPPSEY

SEQ ID NO: 794912 - protein, 137 aa, Homo sapiens
  misc_feature: NA.14.53.E09.1.454.light.4.nb-aa
MAWIPLLLLLLTLCTGSQASYELTQPPSVSVSPGQTARITCSGDLLTKQYAFWYQQKPGQAPLLIIYKDTERPSGIPERFSGSSSGTTLTLTISAVQAEDEADYYCQSAVSTNSYRVFGGGTKLTVLGQPKAAPSVY

SEQ ID NO: 794913 - protein, 139 aa, Homo sapiens
  misc_feature: NA.14.55.E11.1.454.light.4.nb-aa
MDMRVPAQLLGLLLLWLRGARCDIQMTQSPSSLSASVGDRVTITCRASQSIKNYLNWYQQKPGKAPDLLIYAASSLHSGVPSRFSGSGSGTDFTLTVSSLQPEDFATYYCQQSYSTPLTFGGGTKAEIRRTVAAPSVFS

SEQ ID NO: 794914 - protein, 140 aa, Homo sapiens
  misc_feature: NA.14.57.F02.1.454.light.4.nb-aa
MEAPAQLLFLLLLWLPDTTGEIVLTQSPLTLSLSPGERATLSCRASQSVNTNLAWFQQKPGQAPRLLMYDASHRATGIPARFSGSGSGTDFTLTISSLESEDFAVYYCQQRGNWPLTFGGGPKVEFKRTVAAPSVFIFPP

SEQ ID NO: 794915 - protein, 141 aa, Homo sapiens
  misc_feature: NA.14.85.H08.1.454.light.4.nb-aa
MAWALLLLSLLTQGTGSWAQSALTQPPSASGSPGQSVTISCTGTSSDVGAYNFVSWYQQHPGKAPKLMIYDVNKRPSGVPDRFSGSKSGNTASLTVSGLQADDEADYYCSSHAVSNNFGVFGGGTKLTVLSQPKAAPSVTL

SEQ ID NO: 794916 - protein, 148 aa, Homo sapiens
  misc_feature: NA.15.1.A01.1.454.light.4.nb-aa
MAWALLLLTLLTQDTGSWAQSALTQPASVSGSPGQSITISCTGTSSDVGGYHLVSWYQHHPGRAPKLMIYEATKRPSGLSNRFSGSKSGNTASLTISGLQADDEANYYCCSYEGYNTILFGGGTKLTVLRQPKAAPSVTLFPPSSLRR

SEQ ID NO: 794917 - protein, 139 aa, Homo sapiens
  misc_feature: NA.15.25.C03.1.454.light.4.nb-aa
MRLPAQLLGLLMLWVSGSSGDIVMTQSPLSLPVTPGEPASISCRSSQSLQHTDGYNYLDWYLQKPGQSPQLLIYLGSNRASGVPDRFSGSGSGIDFTLKISRVEAEDVGVYYCMQGLQTPITFGRGTRLEIKRTVAAPS

SEQ ID NO: 794918 - protein, 148 aa, Homo sapiens
  misc_feature: NA.15.26.C04.1.454.light.4.nb-aa
MDMRVPAQLLGLLLLWLPGAQCDIQMTQSPSTLSASVGDRVTITCRASQSVTNWLAWYQQKPGKAPNLLIYDASSLESGVPSRFSGSGFGTEFTLTIRSLQPEDFATYYCQQYNSNSPWTFGQGTRVDIKRTVAAPSVFIFPPSELRR

SEQ ID NO: 794919 - protein, 139 aa, Homo sapiens
  misc_feature: NA.15.3.A03.1.454.light.4.nb-aa
MVLQTQVFISLLLWISGAYGDIVMTQSPDSLAVSLGERATINCKSSQSVLYSSNNKNYLAWYQKKPGQPPKLLIYWASTRESGVPDRFSGSGSGTDFTLTISSLQAEDVAVYYCQQYESIPFTFGPGTKVDIKRTVAAP

SEQ ID NO: 794920 - protein, 141 aa, Homo sapiens
  misc_feature: NA.15.37.D04.1.454.light.4.nb-aa
MDMRVPAQLLGLLLLWLPGAMCDIQMTQSPSTLSASVGDRVTFTCRASQNITRWLAWYQQKPGKAPKSLIKKASTLEAGVPSRFSAGGSGTEFTLTINSLEPDDFATYYCQHYDTHPYTFGQGTKLEIKGTVAAPSVFIFP

SEQ ID NO: 794921 - protein, 135 aa, Homo sapiens
  misc_feature: NA.15.49.E05.1.454.light.4.nb-aa
MEAPAQLLFLLLLWLPDTTGEIVMTQSPATLSVSPGERATLSCRASQSIDSKLAWYQQKPGQTPRLVIFATSARATGIPATFSGSGSGTEFILTISSLQSEDFAVYYCQQYNDWPPTFGQGTKVEIKRTVAAPSV

SEQ ID NO: 794922 - protein, 149 aa, Homo sapiens
  misc_feature: NA.15.57.F02.1.454.light.4.nb-aa
FAWALLLLTLLTQGTGSWAQSALTQPASVSGSPGQSITISCTGTNIDVGDYNFVSWYQQHPGKAPKLIIYEVSKRPSGVSNRFSGSKSGNTASLTVSGLQTEDEADYYCHSYRSSTTPVVFGGGTKLTVLGQPKAAPSVTLFPPSSLRR

SEQ ID NO: 794923 - protein, 136 aa, Homo sapiens
  misc_feature: NA.15.58.F03.1.454.light.4.nb-aa
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQHSNWLLSFGGGTKVEIKRTVAAPSVF

SEQ ID NO: 794924 - protein, 153 aa, Homo sapiens
  misc_feature: NA.15.59.F04.1.454.light.4.nb-aa
MSVPTMAWMMLLLGLLAYGSGVDSQTVVTQEPSFSVSPGGTVTLTCGLSSGSVSTPYYPSWYQQTPGQPPRTLIYSTNTRSSGVPDRFSGSILGNKAALTITGAQADDESVYYCVLYMGAGISVFGGGTKLTVLGQPKAAPSVTLFPPSSLRR

SEQ ID NO: 794925 - protein, 140 aa, Homo sapiens
  misc_feature: NA.15.66.F11.1.454.light.4.nb-aa
MAWALLLLSLLTQGTGSWAQSALTQPPSASGSPGQSVTISCTGTIGDYNYVSWYQQHPGKAPKVIIYELTKRPSGVPDRFSGSKSGDSASLTVSGLQPEDEADYFCGSYGDNYSFVFGSGTKVTVLSQPKANPTVTLFPP

SEQ ID NO: 794926 - protein, 145 aa, Homo sapiens
  misc_feature: NA.15.76.G10.1.454.light.4.nb-aa
MAWTPLFLFLLTCCPGSNSQTVVTQEPSLTVSPGGTVTLTCASNTGAVTSAYYPNWFQQKPGQAPRALIYSTNNKHSWTPARFSGSLLGGKAALTLSGVQPEDEADYYCLLYFGGAVLFGGGTKLTVLSQPKAAPSVTLFPPSSL

SEQ ID NO: 794927 - protein, 144 aa, Homo sapiens
  misc_feature: NA.15.8.A08.1.454.light.4.nb-aa
ETASSLLLFLLLLWLPDTTGEVVMTQSPATLSVSPGERATLSCRASQRVAASLAWYQQKPGQPPRLLIYAASIRDTGIPARFSGSGSGTEFTLTISSPQSEDFAVYYCQQYNKWPFTFGPGTKVDIKRTVAAPSVFIFPPSELR

SEQ ID NO: 794928 - protein, 149 aa, Homo sapiens
  misc_feature: NA.16.1.A01.1.454.light.4.nb-aa
MAWALLLLTLLTQGTGSWAQSALTQPASVSGSPGQSITISCTGTNIDVGDYNFVSWYQQHPGKAPKLIIYEVSKRPSGVSNRFSGSKSGNTASLTVSGLQTEDEADYYCHSYRSSTTPVVFGGGTKLTVLGQPKAAPSVTLFPPSSSST

SEQ ID NO: 794929 - protein, 138 aa, Homo sapiens
  misc_feature: NA.16.10.A10.1.454.light.4.nb-aa
MAWIPLLLPLLTLCTGSEASFELTQPPSVSVSPGQTARITCSSDALPRQYASWYQQKPGQAPVVVIYKDTQRPSGIPGRFSGSSSGTTVTLTIGGVQAEDEGDYYCQSANTTAAVFGGGTKLTVLRQPKAAPSVTLFP

SEQ ID NO: 794930 - protein, 138 aa, Homo sapiens
  misc_feature: NA.16.38.D05.1.454.light.4.nb-aa
MEAPAQLLFLLLLWLPDTTGEVVMTQSPATLSVSPGESATLSCRASQSVATNLAWYQQKPGQAPRLLIYGASTRATDVPGRFSGSGFGTDFTLTISTLQSEDFAIYYCQQYNYWPPYTFGQGTKLEIKRTVAAPSVFI

SEQ ID NO: 794931 - protein, 148 aa, Homo sapiens
  misc_feature: NA.16.46.E02.1.454.light.4.nb-aa
MAWALLLLTLLTQGTGSWAQSALTQPPSVSGSPGQSVTISCTGTSSDVGSYNRVSWYQQPPGTAPKLMIYEVSNRPSGVPDRFSGSKSGNTASLTISGLQAEDEADYYCSLYTGNNTFVFGTGTKVTVLGQPKANPTVTLFPPSSSST

SEQ ID NO: 794932 - protein, 136 aa, Homo sapiens
  misc_feature: NA.16.49.E05.1.454.light.4.nb-aa
MAWALLLLTLLTQDTGSWAQSALTQPASVSGSPGQSITISCTGSGSDVGGYNLVSWYQQHPDKAPKLMIYEGNKRPSGVSNRFSGSTSGNTASLTISGLQAEDEADYYCCSYSSRVTMLFGGGTKVTVLGQPKAAP

SEQ ID NO: 794933 - protein, 147 aa, Homo sapiens
  misc_feature: NA.16.59.F04.1.454.light.4.nb-aa
MAWTPLFLFLLTCCPGSNSQAVVTQEPSLTVSPGGTVTLTCGSSTGAVTNGHYPYWFQQKPGQAPRTLIYDTNNKHSWTPARFSGSLVGGKAALTLSGAQPEDEAEYYCLLSYSGVRVFGGGTKLTVLGQPKAAPSVTLFPPSSSST

SEQ ID NO: 794934 - protein, 140 aa, Homo sapiens
  misc_feature: NA.16.68.G02.1.454.light.4.nb-aa
MDMRVPAQLLGLLLLWLPGARCDIQMTQSPSTLSASVGDRVTITCRASQNINRWLAWYQQKPGKAPKVLIYETSTLESGVPSRFSGSGSGTEFTLTITSLQPDDFATYYCQQYHHHCNFGGGTKVEVKRTVAAPSVFIFP

SEQ ID NO: 794935 - protein, 146 aa, Homo sapiens
  misc_feature: NA.16.73.G07.1.454.light.4.nb-aa
MVLQTQVFISLLLWISGAYGDIVMTQSPDSLAVSLGERATINCKSSQSVLYNSNNKSYLAWYQHKSGQPPKLLIYWASTRESGVPDRFSGSGSGTDFTLTISSLQAEDVAVYYCQQYYNNPFNFGGGTKVEIKRTVAAPSVFIFPP

SEQ ID NO: 794936 - protein, 146 aa, Homo sapiens
  misc_feature: NA.16.83.H06.1.454.light.4.nb-aa
MAWTVLLLGLLSHCTGSVTSYVLTQPPSVSVAPGQTASITCGGNGLGRKSVHWYQQKPGQAPVLVVYDDSDRPSGIPERFSGSNSGNAATLTISRVEAGDEADYYCQVWDSSSDHYVFGSGTRVTVLGQPKANPTVTLFPPSSSST

SEQ ID NO: 794937 - protein, 142 aa, Homo sapiens
  misc_feature: NA.16.88.H11.1.454.light.4.nb-aa
MAWTPLFLFLLTCCPGSNSQAVVTQEPSLTVSPGGTVTLTCGSSTGAVTNGHYPYWFQQKPGQAPRTLIYDTNNKHSWTPARFSGSLVGGKAALTLSGAQPEDEAEYYCLLSYSGVRVFGGGTKLTVLGQPKAAPSVTLFPP

SEQ ID NO: 794938 - protein, 140 aa, Homo sapiens
  misc_feature: NA.16.9.A09.1.454.light.4.nb-aa
MAWIPLFLGVLAYCTGSVASYELTQLPSVSVSPGQTASITCSGDNLGSKFTFWYQRKPGQSPVLVIYKDRNRPSDIPERFSGSSSGNTATLTITGTQTMDEADYYCQAWDSGTVVFGGGTKLTVLGQPKAAPSVTLFPPS

SEQ ID NO: 794939 - protein, 143 aa, Homo sapiens
  misc_feature: NA.17.2.A02.1.454.light.4.nb-aa
MASFPLLLTLLTHCAGSWAQSVLTQPPSASGTPGQRVTISCSGSSSNIGTNTVTWFQHVPGTAPKLVMYNYSQRPSGVPDRFAGSNSGTSASLAISGLQSEDEADYYCAAWDASLSSPVFGTGTKVTVLRQPKANPTVTLFPP

SEQ ID NO: 794940 - protein, 147 aa, Homo sapiens
  misc_feature: NA.17.21.B10.1.454.light.4.nb-aa
MRLPAQLLGLLMLWVPASSGDVVMTQSPLSLPVTLGQPASISCRSSQSLVHSDGNIYFMWFQQRPGQSPRRLIYKVSDRDSGVPDRFSGSGSDTDFTLKISRVEAEDVGVYYCMQGTLWPFTFGQGTKLDIRRTVAAPSVFIFPPSD

SEQ ID NO: 794941 - protein, 140 aa, Homo sapiens
  misc_feature: NA.17.23.C01.1.454.light.4.nb-aa
MAWTVLLLGLLSHCTGSVASYVLTQPPSVSVAPGQTATITCGGRNIGSKSVQWYQQKPGQAPILVVYDDSDRPSGIPERFSGSNSDNTATLTISRVGAGDEGDYYCQVWDHTSDHYVFGSGTEVTVLGQPKANPTVTLFP

SEQ ID NO: 794942 - protein, 144 aa, Homo sapiens
  misc_feature: NA.17.25.C03.1.454.light.4.nb-aa
MDMRVPAQLLGLLLLWLRAARCDIQMTQSPSSLSASVGVRVTITCRTSHGVKTYLNWYQQKPGKAPDLLISGASTLRSGVPSRFSGSGSGTDFNLTITTLQPEDCAIYYCQQSYSSPRTFGQGTKVEIKRTVAAPSVFIFPPSD

SEQ ID NO: 794943 - protein, 137 aa, Homo sapiens
  misc_feature: NA.17.27.C05.1.454.light.4.nb-aa
MAWTPLWLTLLTLCIGSVVSSELTQDPAVSVALGQTVRITCRGDSLRSYYASWYQQKPGQAPVLVIYGKNNRPSGIPDRFSGSDSGKTASLTITGAQAEDEADYYCNSRDSSADQVVFGGGTHLTVLGQPKAAPSVT

SEQ ID NO: 794944 - protein, 145 aa, Homo sapiens
  misc_feature: NA.17.28.C06.1.454.light.4.nb-aa
MAGFPLLLTLLTHCAGSWAQSVLTQPPSVSGTPGQRVTISCSGNSSGISTKHFCWYQQFPGSAPRLLIYRNDHRPSGVPDRFSGSMSGTSASLTISGLRSEDEADYYCAPWDDILNGPVFGGGTRLTVLSQPKAAPSVTLFPPSS

SEQ ID NO: 794945 - protein, 148 aa, Homo sapiens
  misc_feature: NA.17.34.D01.1.454.light.4.nb-aa
MRLPAQLLGLLMLWIPGSSADIVMTQTPLSLSVTPGQPASISCKSSQSLLHSGEGKTFLYWFLQRPGQSPHLLIYEVSNRFAGLPDRFSGSGSGTDFTLKISRVEAEDVGIYYCMQGIELPPTFGQGTKVELKRTVAAPSVFIFPPSD

SEQ ID NO: 794946 - protein, 136 aa, Homo sapiens
  misc_feature: NA.17.35.D02.1.454.light.4.nb-aa
MDMRVPAQLLGLLLLWLPGARCDIQMTQSPSTLSASVGDRVTITCRASQNINRWLAWYQQKPGKAPKVLIYETSTLESGVPSRFSGSGSGTEFTLTITSLQPDDFATYYCQQYHHHCNFGGGTKVEVKRTVAAPSV

SEQ ID NO: 794947 - protein, 141 aa, Homo sapiens
  misc_feature: NA.17.37.D04.1.454.light.4.nb-aa
MAWTVLLLGLLSHCTGSVTSYVLTQPPSVSVAPGQTARITCGGNNVGSKTVHWYQQKPGQAPVLVVYDDTDRPSGIPERFSGSNSGNTATLTIGRVEAGDEADYYCQVWDSSSDHVVFGGGTKLTVLGQPKAAPSVTLFPP

SEQ ID NO: 794948 - protein, 142 aa, Homo sapiens; identical to SEQ ID NO: 794937
  misc_feature: NA.17.42.D09.1.454.light.4.nb-aa

SEQ ID NO: 794949 - protein, 134 aa, Homo sapiens
  misc_feature: NA.17.49.E05.1.454.light.4.nb-aa
MEAPAQLLFLLLLWLPDTTGEIVMTQSPATLSVSPGERATLSCRATQSITSNLAWYQQKPGQAPRLLIYGASTRATGIPARFSGSGSGTEFTLTISSLQSEDFAVYYCQQYNDWPPLTFGGGTKVEIKRTVAAP

SEQ ID NO: 794950 - protein, 135 aa, Homo sapiens
  misc_feature: NA.17.57.F02.1.454.light.4.nb-aa
MDMRVPAQLLGLLLLWLRGARCDIQMTQSPSSLSASVGDRVTISCRASQSISNFLNWYQREPGKAPKLLIYTASNLQSGVPSRFSGSGSGTDFTLTISSLQPEDFATYYCQQGYSTPYTFGQGTKLEIKRTVAAP

SEQ ID NO: 794951 - protein, 136 aa, Homo sapiens
  misc_feature: NA.17.86.H09.1.454.light.4.nb-aa
MAWALLLLTLLTQGTGSWAQSALTQPASVSGSPGQSITISCTVTSSDLSAYNYVSWYQQHPGKVPKAMIYEVSNRPSGVSNRFSGSKSGNTASLTISGLQPEDEADYYCISFVSSSLVLFGGGTKLTVLGQPKAAP

SEQ ID NO: 794952 - protein, 138 aa, Homo sapiens
  misc_feature: NA.17.87.H10.1.454.light.4.nb-aa
MAWALLLLTLLTQDTGSWAQSALTQPASVSGSPGQSITISCTGSGSDVGGYNLVSWYQHHPDKAPKLILYEGTKRPSGVSNRFAGSTSGSTASLTISGLQAEDEADYYCCSYSSRVTMIFGGGTKVTVLGQPKAAPSV

SEQ ID NO: 794953 - protein, 148 aa, Homo sapiens
  misc_feature: NA.2.34.D01.1.454.light.4.nb-aa
FAWALLLLTLLTQGTGSWAQSALTQPPSASGSPGQSVTISCTGISSDLSPYNYVSWYQQHPGKAPKLIIYEVTKRPSGVPDRFSGSKSGETASLTVSGLQAEDEADYYCSSYAGSNNVAFGGGTKLTVLGQPKAAPSVTLFPPSSVER

SEQ ID NO: 794954 - protein, 139 aa, Homo sapiens
  misc_feature: NA.2.35.D02.1.454.light.4.nb-aa
MAWALLLLTLLTQGTGSWAQSALTQPPSASGSPGQSVTISCTGGSSDVGGYNYVSWYQQHPGEAPKLLIYEVTKRPLGVPDRFSGSKSGRTASLTVSGLQAEDEADYYCSSYAGSSNVLFGGGTKLTVLGQPKAAPSVT

SEQ ID NO: 794955 - protein, 139 aa, Homo sapiens
  misc_feature: NA.3.19.B08.1.454.light.4.nb-aa
MDMRVPAQLLGLLLLWLRDARCDTQMTQSPSSLSASVGDRVIISCRASQSVSIYLNWYQFKPGKAPKLLIYAASSLQSGVPSRFSGSGSGTDFTLTISSLQPEDFATYYCQQSYDTPPLTFGGGTKVEIKRTVAAPSVF

SEQ ID NO: 794956 - protein, 138 aa, Homo sapiens
  misc_feature: NA.3.35.D02.1.454.light.4.nb-aa
MRLPAQLLGLLMLWVPGSSGDVVVTQSPLSLPVTLGQPASISCRSGQSLVYGDGNTYLNWYQQRPGQSPRRLIYKVSNRDAGVPDRFSGTGSGTDFTLRISRVEAEDVGIYFCMQATHWPYTFGQGTKLEIKRTVAAP

SEQ ID NO: 794957 - protein, 136 aa, Homo sapiens
  misc_feature: NA.3.36.D03.1.454.light.4.nb-aa
METPAQLLFLLLLWLPDTTGEIVLTQSPATLSLSPGERATLSCGASQSVPSNYIAWYQHKVGLAPRLLIYDTFTRATGIPDRFRGSGYGTDFTLTISRLEPGDFAVYYCQQYGTSQTFGQGTRLEIKRTVAAPSVF

SEQ ID NO: 794958 - protein, 133 aa, Homo sapiens
  misc_feature: NA.3.46.E02.1.454.light.4.nb-aa
MEAPAQLLLLLLLWLPDTTGEVVLMQSPGTLSVSPGERATLSCRASQSVRHNLGWYQQKPGQAPRLLIHGASNRADGIPARFSGSGYGTDFTLTISNLQSEDFAVYFCQQFNTWPGSFGQGTKLELKRTVAAP

SEQ ID NO: 794959 - protein, 136 aa, Homo sapiens
  misc_feature: NA.3.5.A05.1.454.light.4.nb-aa
MDMRVPAQLLGLLLLWFPGSRCDIQLTQSPSFVSASVRDRLTITCRASQDISTNLAWYQQKPGRAPKLLIYGASSLQSGVPSRFRGSGSGTDFTLTISGLQPEDYATYYCQSSNSFPRTFGQGTKVEIKRTVAAPS

SEQ ID NO: 794960 - protein, 134 aa, Homo sapiens
  misc_feature: NA.3.77.G11.1.454.light.4.nb-aa
MEAPAQLLFLLLLWLPDTTAQIVMTQSPATLSVSPGETVSLSCRASQSVNNNLAWYQQKPGQAPRLLIYDVSSRVTGLPGRFSGSGSGTEFTLTIIRLRSDDFAVYFCQQYDGRPPWTFGQGTKVDIRRTVAAP

SEQ ID NO: 794961 - protein, 137 aa, Homo sapiens
  misc_feature: NA.3.78.H01.1.454.light.4.nb-aa
MEAPAQLLFLLLLWLPDSTGEIVLTQSPATLSLSPGERAALSCRASQSVSSFLAWYQQKPGQAPRLLIYDASNRATGIPARFSGSGSGTDFTLTISSLEPEDFAVYYCQQRSNWLITFGQGTRLEIKRTVAAPSVFI

SEQ ID NO: 794962 - protein, 135 aa, Homo sapiens
  misc_feature: NA.3.88.H11.1.454.light.4.nb-aa
MDMRVPAQLLGLLLLWFPGSRCDIQMTQSPSSVSASVGDRVTITCRASQGISSWLAWYQQKPGKAPKLLIYAASTLQTGVPSRFSGRGSGTDFTLTISSLQPEDFATYYCQQANSFPLIFGQGTRLEIKRTVAAP

SEQ ID NO: 794963 - protein, 135 aa, Homo sapiens
  misc_feature: NA.4.1.A01.1.454.light.4.nb-aa
MEAPAQLLFLLLLWLPESAGEIVVTQSPATLSVSPGERATLSCRANQSIGHSLAWYQQKPGQAPGLLISAASIRATGIPARFRGSGSGTEFTLTISSLQSDDVAVYYCHQYGDRPTFGQGTKVEIKRTVAAPSVF

SEQ ID NO: 794964 - protein, 142 aa, Homo sapiens
  misc_feature: NA.4.10.A10.1.454.light.4.nb-aa
MASFPLLLTLLTHCAGSWAHSVLTQPPSASGTPGQRVTISCSGSTSNIGSNPVNWFQQLPGRAPKVLIYGQNQRPSGVPDRFSGSKSDTSASLAISGLQSEDEADYYCATWDDILRGAVFGGGTKLTVLGQPKAAPSVTLFP

SEQ ID NO: 794965 - protein, 136 aa, Homo sapiens
  misc_feature: NA.4.12.B01.1.454.light.4.nb-aa
MDMRVPAQLLGLLLLWFPGSRCDIQLTQSPSFVSASVRDRLTITCRASQDISTNLAWYQQKPGRAPKLLIYGASSLQSGVPSRFRGSGSGTDFTLTISGLQPEDYVTYYCQSSNSFPRTFGQGTKVEIKRTVAAPS

SEQ ID NO: 794966 - protein, 150 aa, Homo sapiens
  misc_feature: NA.4.22.B11.1.454.light.4.nb-aa
MRLPAQLLGLLMLWVPGSSGDVVMTQSPLSLPVTLGQPASISCRSSQSLVYSDGNTYLNWFQQRPGQSPRRLIYEVSNRDSGVPDRFSGSGSGTDFTLKISTVEAEDVGVYFCMQGTHWPYTFGQGTKLEIKRTVAAPSVFIFPPSDYSA

SEQ ID NO: 794967 - protein, 136 aa, Homo sapiens
  misc_feature: NA.4.23.C01.1.454.light.4.nb-aa
MEAPAQLLFLLLLWLPDTTGEIILTQSPATLSVSPGERATLSCRASQSVSSNLAWYQQKPGQTPRLLIFGAFTRATDIPTRFSGSGSGTEFTLTISNLQSEDSAVYYCHQYYSWPPWTFGQGTKVEIKRTVAAPSV

SEQ ID NO: 794968 - protein, 137 aa, Homo sapiens
  misc_feature: NA.4.24.C02.1.454.light.4.nb-aa
MDMRVPAQLLGLLLLWLPGAKCDVQMTQSPSTLSASIGDRVTITCRASQSISNWLAWYQQKPGKAPKLLISDASTLHGGVPPTFSGSGSGTEFTLTISSLQPDDVATYYCQQYNSYWTFGQGTKVEIRRTVAAPSVF

SEQ ID NO: 794969 - protein, 145 aa, Homo sapiens
  misc_feature: NA.4.29.C07.1.454.light.4.nb-aa
METPAQLLFLLLLWLPDATGEIVLTQSPATLSLSPGERATLSCRASQNVSSRFLAWYQQRRGQAPRLIIYGASSRATGIPDRFSGSGSGTDFTLTISDLEPEDFAVYYCQQYGSARTFGQGARVEIKRTVAAPSVFIFPPSDYSA

SEQ ID NO: 794970 - protein, 149 aa, Homo sapiens
  misc_feature: NA.4.37.D04.1.454.light.4.nb-aa
FAWALLFLTLLTQGTGSWAQSALTQPASVSGSPGQSIIAISCTGTSSDVGGYNYVSWYQQHPGKAPKLIIYDVSNRPSGVSNRFSGYKSGNTASLTISGLQAEDEADYYCSSYTSSSTGVFGTGTKVTVVPRQPKANPTVTLFPPSSYS

SEQ ID NO: 794971 - protein, 136 aa, Homo sapiens
  misc_feature: NA.4.38.D05.1.454.light.4.nb-aa
METPAQLLFLLLLWLPDTTGEIVLTQSPGTLSLSPGERATLSCRASQSVSSSYLTWYQQKPGQAPRLLIYGASSRATGIPDRFSGSGSGTDFTLTISRLEPEDFAVYYCQQCGSSPTFGQGTEGRKSNETVAAPSV

SEQ ID NO: 794972 - protein, 134 aa, Homo sapiens
  misc_feature: NA.4.52.E08.1.454.light.4.nb-aa
MEAPAQLLFLLLLWLPDTTGEIVLTQSPATLSLSPGERATLSCRASQSVSSYLAWYQQKPGQAPRLLIYDASDRATGIPARFSGSGSGTDFTLTITSLEPEDFAVYYCQQRSNWPLLTFGGGTKVEIKRTVAAP

SEQ ID NO: 794973 - protein, 146 aa, Homo sapiens
  misc_feature: NA.4.61.F06.1.454.light.4.nb-aa
METPAQLLFLLLLWLPDAAGEVVLTQSPGTLSLSPGESATLSCRPSEAVRSDYLAWYQQKPGQAPRLLIQGASNRATGIPARFSGRASGTVFTLTISGLEPEDFAVYFCQQYGTSPVTFGQGSRLEIKRTVAAPSVFIFPPSDYSA

SEQ ID NO: 794974 - protein, 141 aa, Homo sapiens
  misc_feature: NA.4.64.F09.1.454.light.4.nb-aa
VDMRVPAQLLGLLLLWFPGSRCDIQMTQSPSSVSASVGDRVTITCRASQDIGTRLAWYQQKPGKAPNLLIYAASSLHSGVPLRFSGSGSETDFSLTIRDLQPEDFATYFCQQTNSFPRSFGQGTKVEIKRTVAAPSVFILP

SEQ ID NO: 794975 - protein, 140 aa, Homo sapiens
  misc_feature: NA.4.71.G05.1.454.light.4.nb-aa
MAWTPLLLPLLTFCTVSEASYELTQPPSVSVSPGQTARITCSGDALPKKYAYWYQQKSGQAPKLVIYEDDKRPSGIPERFSGSSSGTMATLTISGAQVEDEADYYCYSIENSDNFWVFGGGTKLTVLGQPKAAPSVTLFP

SEQ ID NO: 794976 - protein, 137 aa, Homo sapiens
  misc_feature: NA.4.9.A09.1.454.light.4.nb-aa
MEAPAQLLFLLLLWLPDTTGEIVMTQSPATLSVSPGARATLSCRASQSVSNNLAWYQQKPGQPPRLLIYGTSTRATGIPVRFSGSGSGTEFTLTISSLQSEDFAVYYCQQYNNWPPFTFGPGTKVDIKRTVAAPSVF

SEQ ID NO: 794977 - protein, 147 aa, Homo sapiens
  misc_feature: NA.5.14.B03.1.454.light.4.nb-aa
MDMRVPAQLLGLLLLWFPGSRCDIQMTQSPSFVSASVGDRLTLTCRASHDISTRLAWYQQKPGKAPKLLIYAASSLQSGVPSRFSGSGSGTDFTLTISRLQPEDFATYYCQNTNSLPRSFGQGTKVEIKRTVAAPSVFIFPPSDVSD

SEQ ID NO: 794978 - protein, 138 aa, Homo sapiens
  misc_feature: NA.5.23.C01.1.454.light.4.nb-aa
MDMRVPAQLLGLLLLWLRDARCDTQMTQSPSSLSASVGDRVIISCRASQSVSIYLNWYQFKPGKAPKLLIYAASSLQSGVPSRFSGSGSGTDFTLTISSLQPEDFATYYCQQSYDTPPLTFGGGTKVEIKRTVAAPSV

SEQ ID NO: 794979 - protein, 138 aa, Homo sapiens
  misc_feature: NA.5.24.C02.1.454.light.4.nb-aa
MAWALLLLTLLTQGTGSWAQAALTQPPSASGSPGQSVTISCTATSSDVGGSKYVSWYQQHPDKAPKLIIFEVTTRPSGVPDRFSGSKSGNTASLTVSGLQAEDEADYYCSSYAGSSSPHVIFGGGTKLTVLGQPKAAP

SEQ ID NO: 794980 - protein, 145 aa, Homo sapiens
  misc_feature: NA.5.27.C05.1.454.light.4.nb-aa
MAWTFLLLGLLSHCTGSVTSYVLTQPPSVSVAPGKTAGITCGGNNIGGKSVNWYQQKPGQAPVLVIYYDTDRPSGIPERFSGSKSGNTATLTISRVEAGDEADYYCQVWNGDYDYVFGTGTKVTVLGQPKANPTVTLFPPSSVSD

SEQ ID NO: 794981 - protein, 143 aa, Homo sapiens
  misc_feature: NA.5.28.C06.1.454.light.4.nb-aa
MDMRVPAQLLGLLLLWLSGARCDIQMTQSPSSVSASVGDRVTITCQASQDIGNYLTWYQQKPGKVPKLLIYDASNLEIGVSSRFSGSGSGTEFTFTISSLQPEDIATYYCQQYDSLAAFGGGTKVEIERTVAAPSVFIFPPSD

SEQ ID NO: 794982 - protein, 136 aa, Homo sapiens
  misc_feature: NA.5.35.D02.1.454.light.4.nb-aa
MEAPAQLLFLLLLWLPDTVGEIVMTQSPAILSVSPGERATLSCRASQNIGSNLAWYQQKPGQPPRLLIYRSSTRATDVPTRFSGRGSGTDFSLTISSVQSEDLAVYYCQQCGQWPRTFGPGTTVDIRRTVAAPSVF

SEQ ID NO: 794983 - protein, 134 aa, Homo sapiens
  misc_feature: NA.5.40.D07.1.454.light.4.nb-aa
MEAPAQLLFLLLLWLPDTIGEIVMTQSPATLSVSPGERATLSCRASQSVSSRLAWYQQKPGQAPRLLIYGASTRATGIPARFSGSGSGTEFTLTISSLQSEDFAVYYCQQYNDWWTFGQGTKVETKRTVAAPSV

SEQ ID NO: 794984 - protein, 142 aa, Homo sapiens
  misc_feature: NA.5.45.E01.1.454.light.4.nb-aa
PSNTLPAQLLGLLLLWFPGSRCDIQMTQSPSFVSASVGDRLTIACRASQDISTRLAWYQQKPGRAPKLLIYAASSLQSGVPSRFRGSGSGTDFTLTISGLQPEDYATYYCQSSNAFPRTFGQGTKVEIKRTVAAPSVFIFPP

SEQ ID NO: 794985 - protein, 142 aa, Homo sapiens
  misc_feature: NA.5.48.E04.1.454.light.4.nb-aa
METPAQLLFLLLLWLPDSAGEVVLTQSPGTLSLSPGESATLSCRASESLSGDYLAWYQQKPGQSPRLLISGVSFRATGVPGRFRGSGSGTDFTLTISRLEPEDFALYFCQQYVFAPFTFGGGTKVESRRTVAAPSVFIFPPS

SEQ ID NO: 794986 - protein, 136 aa, Homo sapiens; identical to SEQ ID NO: 794982
  misc_feature: NA.5.57.F02.1.454.light.4.nb-aa

SEQ ID NO: 794987 - protein, 140 aa, Homo sapiens
  misc_feature: NA.5.58.F03.1.454.light.4.nb-aa
MAWALLLLTLLTQDTGSWAQSALTQPASVSGSPGQSITISCTGTSSDVGGYNLVSWYQQQPGKAPKLLVYQGNKRPSGVSNRFSGSKSGNTAALTISGLQADDEADFYCCSYAGDHTFMFGTGTKVTVLGQPKANPTVTL

SEQ ID NO: 794988 - protein, 138 aa, Homo sapiens
  misc_feature: NA.5.6.A06.1.454.light.4.nb-aa
MDMRVPAQLLGLLLLWFPGSRCDIQMTQSPSSVSASIGDRVTITCRASQGLNNYLAWYQQKPGKAPKLLIYATSSLQSGVPSRFSGSGTGIDFTLTITSLQPEDLATYYCQQARRTPWTFGQGTKVEIKRTVAAPSVF

SEQ ID NO: 794989 - protein, 137 aa, Homo sapiens
  misc_feature: NA.5.60.F05.1.454.light.4.nb-aa
MASFPLLLTLLTHCAGSWAQSVLTQPPSASGTPGQRVTISCSGSTSNIGSNIVNWYQQLPGTAPKLLIYRNNQRPSGVPDRFSGSKSGTSASLAIRGLQSEDESDYYCATWDDSLNGPVFGGGTKLTVLGQPKAAPS

SEQ ID NO: 794990 - protein, 147 aa, Homo sapiens
  misc_feature: NA.5.86.H09.1.454.light.4.nb-aa
MAWALLLLTLLTQGTGSWAQSALTQPPSASGSPGQSVTISCTGTSSDIGRYNYVSWYQQHPGKAPKLVISEVSKRPSGVPDRFSGSKSGNTASLTVSGLQTEDEADYYCSSFAGSRILFGGGTKLTVLGQPKAAPSVTLFPPSSVSD

SEQ ID NO: 794991 - protein, 136 aa, Homo sapiens
  misc_feature: NA.7.1.A01.1.454.light.4.nb-aa
MAWALLLLTLLTQGTGSWAQSALTQPPSASGSPGQSVTISCTGTSSDVGGYKYVSWYQQHPGKAPKLMIYEVTKRPSGVPDRFSGSKSGNTASLTVSGLQAEDEADYYCCSYAGRNSDLFGGGTKLTVLGQPKAAP

SEQ ID NO: 794992 - protein, 149 aa, Homo sapiens
  misc_feature: NA.7.21.B10.1.454.light.4.nb-aa
MEAPAQLLFLLLLWLPVSDTTGEIVLTQSPATLSLSPGERATLSCRASQSVGAYVAWYQQKPGQAPRPLIYGASNRATGIPARFSGSGSGTDFTLTIISLEPEDVAVYYCQHRTEWPPGATFGPGTKVDIKRTVAAPSVFIFPPSDRDT

SEQ ID NO: 794993 - protein, 141 aa, Homo sapiens
  misc_feature: NA.7.34.D01.1.454.light.4.nb-aa
MAWALLFLSLLTQGTGSWAQSALTQPASVSGSPGQSITISCAGTSSDVGGYNYVSWYQQYPGKAPKLLIYDVSNRPSGVSIRFSGSKSGNTASLTISGLQTEDEADYYCCSYTGDSIIWVFGGGTKLTVLRQPKAAPSVTS

SEQ ID NO: 794994 - protein, 137 aa, Homo sapiens
  misc_feature: NA.7.5.A05.1.454.light.4.nb-aa
MAWALLFLTLLTQGTGSWAQSALTQPASVSGSPGQSITISCTGTTTDVAGYKYLSWYQQYPGKAPKVIIYDVYNRPSGFPNRFSGSKSGDTASLTISGLQAEDEADYYCSSYTGSSTQVFGGGTKLTVLGQPKAAPS

SEQ ID NO: 794995 - protein, 140 aa, Homo sapiens
  misc_feature: NA.7.71.G05.1.454.light.4.nb-aa
MEAPAQLLFLLLLWLPVSDTTGEIVLTQSPATLSLSPGERATLSCRASQSVGAYVAWYQQKPGQAPRPLIYGASNRATGIPARFSGSGSGTDFTLTIISLEPEDVAVYYCQHRTEWPPGATFGPGTKVDIKRTVAAPSVF

SEQ ID NO: 794996 - protein, 137 aa, Homo sapiens
  misc_feature: NA.7.75.G09.1.454.light.4.nb-aa
MDMRVPAQLLGLLLLWFPGSRCDIQMTQSPSSVAASVGDTVTINCRASQDVGDRLVWYQQKPGKGPRLLIYGASRLHSGVPGRFSGGGSRADFTLTINHLQAEDFATYYCQQANRLPPTFGQGTRLEIKRTVAAPSV

SEQ ID NO: 794997 - protein, 133 aa, Homo sapiens
  misc_feature: NA.8.12.B01.1.454.light.4.nb-aa
MAWIPLFLGVLAYCTGSVASYELTQPPSVSVSPGQTARITCSGDKLGDKYACWYQQRPGQSPVLVIYQDNKRPSGIPERFSGSNSGNTATLTISGTQATDEADYYCQAWDSSTYVVFGGGTKLTVLGQPKAAP

SEQ ID NO: 794998 - protein, 139 aa, Homo sapiens
  misc_feature: NA.8.21.B10.1.454.light.4.nb-aa
MDMRVPAQLLGLLLLWLRGASCDIQLTQSPSSLSASVGDSVTITCRASQSINNYLNWYQQKPGKAPKYLVYTASTLQSGVPSRFSGSGFGTVFTLTISSLEPEDFATYYCQQTYNIPRTFGQGTKVEIKRTVAAPSVFI

SEQ ID NO: 794999 - protein, 141 aa, Homo sapiens
  misc_feature: NA.8.23.C01.1.454.light.4.nb-aa
MAWTALLLSLLAHFTGSVASYELTQPLSVSVAPGQTARITCGGFNIGGNNVHWYQQKAGQAPVLVIYGGSIRPGGTPARFSASISGNAATLTISKAQAGDEADYFCQVWDSSIYVFGPGTKVTVLGQPKANPTVTLFPPSS

SEQ ID NO: 795000 - protein, 137 aa, Homo sapiens
  misc_feature: NA.8.24.C02.1.454.light.4.nb-aa
MAWALLFLTLLTQGTGSRAQSALTQPASVSGSPGQSVTISCTGSSSDIGSYNHVSWYQQHPGRAPKLIIYDVTDRPSGVSNRFSGSKSGNTASLTISGLQAEDEAHYYCSSYTTSSTLVVFGGGTKLTVLSQPKAAP

SEQ ID NO: 795001 - protein, 141 aa, Homo sapiens
  misc_feature: NA.8.38.D05.1.454.light.4.nb-aa
MEAPAQLLFLLLLWLPDTTGEIVLTQSPATLSLSPGERATLSCRASQSVTTQLAWYQHKPGQAPRPLIFDASIRATGIPARFSGSGSGTDFTLTISSLEPEDFAVYYCQHRTEWPPGATFGPGTKIEIKRTVAAPSVFIFP

SEQ ID NO: 795002 - protein, 153 aa, Homo sapiens
  misc_feature: NA.8.4.A04.1.454.light.4.nb-aa
MSVPTMAWMMLLLGLLAYGSGVDSETVVTQEPSFSVSPGETVTLTCGLSSGSVSRGYSPSWYQQTPGQAPRMLMYSTNIRTSGVPDRFSGSILGNKAALTITGAQADDESHYYCALHLRDVNYVFGGGTKLTVLGQPKAAPWSLCSPPSSTRE

SEQ ID NO: 795003 - protein, 141 aa, Homo sapiens
  misc_feature: NA.8.42.D09.1.454.light.4.nb-aa
MAWALLLLTLLTQGTGSWAQSALTQPPSASGSPGQSVTISCTGASSDYNYISWYQQHPGKAPKLMIFEVNKRPSGVPDRFSGSKSGNTASLTVSGLQTEDEADYYCSSYSGSNRVFGGGTKLTVLGQPKAAPSVTLFPPSS

SEQ ID NO: 795004 - protein, 146 aa, Homo sapiens
  misc_feature: NA.8.43.D10.1.454.light.4.nb-aa
MAWTPLFLFLLTCCPGSNSQTVVTQEPSLTVSPGGTVTLTCASSTGAVTSGYYPNWFQQKPGQAPRPLIYSTNNRHSWTPARFSGSLLGAKAALTLSGVQPEDEAEYYCLLYYGGPWVFGGGTKLTVLGQPKAAPSVTLFPPSSTR

SEQ ID NO: 795005 - protein, 143 aa, Homo sapiens
  misc_feature: NA.9.14.B03.1.454.light.4.nb-aa
MAWTPLLLPLLTFCTVSEASYDLTQPPSVSVSPGQTARITCSGDGLSKKYVYWYQQKSGQAPLLVIYEDARRPSGIPERISGSSSGTVATLTIGGAQVEDEADYFCYSTDDSADHRGMFGGGTKLTVLGQPKAAPSVTLFPPS

SEQ ID NO: 795006 - protein, 137 aa, Homo sapiens
  misc_feature: NA.9.21.B10.1.454.light.4.nb-aa
MAWALLLLTLLTQDTGSWALSALTQPASVSGSPGQSITISCTGPTTDIGHYNLVSWYQQRPDKAPTLLIYEVTKRPSGVSGRFSASKSGNTASLTISGLQSDDEADYYCSSYAVGSSFKIFGGGTRLTVLSQPKAAP

SEQ ID NO: 795007 - protein, 150 aa, Homo sapiens
  misc_feature: NA.9.25.C03.1.454.light.4.nb-aa
MAWTVLLLGLLSHCTVFVDSVTFHVLTQPPSVSVAPGKTASITCEGDNIKTNNVHWYQQKPGQAPVLVVFDDSDRPSGIPERFSGSNSGNTATLTISGVEAGDEADYFCQLWDSHDGSGGIFGGGTRLTVLSQPKAAPSVTLFPPSSDVS

SEQ ID NO: 795008 - protein, 138 aa, Homo sapiens
  misc_feature: NA.9.27.C05.1.454.light.4.nb-aa
MEAPAQLLFLLLLWLPDINGEIVMTQSPAVLSVSPGERATLSCRASQSVRSNLAWYQQRPGQPPRLLIFDASTRASGIPDRFSGSGSGTEFTLSINSVRAEVFCFYYCQQYDNWPLWTFGQGTKVDVKRTVAAPSVFI

SEQ ID NO: 795009 - protein, 137 aa, Homo sapiens
  misc_feature: NA.9.31.C09.1.454.light.4.nb-aa
MAWALLFLTLLTQGTGSWAQSALTQPASVSGSPGQSIAISCTGTNSDVGAYNYVSWYQQHPGKAPQLIISDVNNRPPGISDRFSGSKSGNTASLTISGLRAEDEAHYYCSSYTTSDTLLFGGGTELTVLGQPKAAPW

SEQ ID NO: 795010 - protein, 141 aa, Homo sapiens; identical to SEQ ID NO: 795001
  misc_feature: NA.9.33.C11.1.454.light.4.nb-aa

SEQ ID NO: 795011 - protein, 149 aa, Homo sapiens
  misc_feature: NA.9.34.D01.1.454.light.4.nb-aa
MAWSPLLLTLLAHCTGSWAQSVLTQPPSVSGAPGQRVTISCTGSSSNIGARYDVHWYQQLPGTAPKVIIYDNMKRPSGVPDRFSGSKSGTSASLAITGLQAEDEADYYCQSYDSGLSNIVFGTGTKVTVLGQPKANPTVTLFPPSSDVS

SEQ ID NO: 795012 - protein, 146 aa, Homo sapiens
  misc_feature: NA.9.37.D04.1.454.light.4.nb-aa
MAWTVLLLGLLSHCTGSVTSYVLTQPPSVSVAPGKTATITCGGYNIGSKSVHWYQQKPGQAPVLVVYDDTDRPSGIPERFSGSNSGDTATLIISRVEVEDEADYYCQVWDSGTDHWVFGGGTKLTVLGQPKAAPSVTLFPPSSDVS

SEQ ID NO: 795013 - protein, 142 aa, Homo sapiens
  misc_feature: NA.9.43.D10.1.454.light.4.nb-aa
MAWALLLLTLLTQGTGSWAQSALTQPPSASGSPGQSVTISCTGTSIGGYDYVSWYQQHPGKAPKLLIYEVSRRPSGVPDRFSGSKSANTASLTVSGLQAEDEADYYCSSYSGSNRVFGGGTKLTVLGQPKAAPSVTLFPPSS

SEQ ID NO: 795014 - protein, 139 aa, Homo sapiens
  misc_feature: NA.9.55.E11.1.454.light.4.nb-aa
MAWTVLLLGLLSHCTGSVTSYVLTQPPSVSVAPGETARITCERNIIGGVSVHWYQQKPGQAPVLVLHHTSDRPSGIPERFSGSNSGKTATLTISRVEAGDEADYYCQVWAGDNDHAGVFGGGTKLTVLSQPKAAPSVTL

SEQ ID NO: 795015 - protein, 149 aa, Homo sapiens
  misc_feature: NA.9.71.G05.1.454.light.4.nb-aa
MAWALLLLTLLTQDTGSWALSALTQPASVSGSPGQSITISCTGPTTDIGHYNLVSWYQQRPDKAPTLLIYEVTKRPSGVSGRFSASKSGNTASLTISGLQSDDEADYYCSSYAVGSSFKIFGGGTRLTVLSQPKAAPSVTLFPPSSDVS

SEQ ID NO: 795016 - protein, 143 aa, Homo sapiens
  misc_feature: NA.9.74.G08.1.454.light.4.nb-aa
MAWTVLLLGLLSHCTGSVTSPVLTQPPSVSVAPGKTARITCEGNNIGSKSVHWYQQRPGQAPVLVLYDDSGRPSGIPERFSGSKSGSTATLTISRVEAGDEADYYCQVWSFNSDHPGVFGGGTKVTVLRQPKAAPSVTLFPPP

SEQ ID NO: 795017 - protein, 141 aa, Homo sapiens
  misc_feature: NA.9.75.G09.1.454.light.4.nb-aa
VDMRVPAQLLGLLLLWLPGANCDIQMTQSPSTLSASVGDRVTISCRASQNVLSWLAWYQQKPGKAPKLLIYEASGLQSGVPSRFSGSGSGTEFTLTISSLQPDDFATYYCQQYNSYPWTFGQGTEVEVKRTVAAPSVFIFP

SEQ ID NO: 795018 - protein, 137 aa, Homo sapiens
  misc_feature: NA.9.77.G11.1.454.light.4.nb-aa
MDMRVPAQLLGLLLLWLPGAKCDIQMTQSPSTLSASVGDRVTITCRASQSIDTSLAWYQQKPGKAPKLLMYYASRLESGVPSRFSGSQSGTDFTLTITSLQPDDFASYYCQQYRIYPWTFGQGTKVEIKRTVAAPSV

SEQ ID NO: 795019 - protein, 146 aa, Homo sapiens
  misc_feature: Description of Unknown: NA.9.86.H09.1.454.light.4.nb-aa
MAWALLLLTLLTQDAGSWAQSALTQPASVSASPGQSITISCTGTSIGSFNLVSWYQHHPGKAPKLMIYEVTKRPSGISARFSGSKSVNTASLTISGLQTEDEAHYYCCSYTGVSSWVFGGGTKLTVLGQPKAAPSVTLFPPSSDVS

SEQ ID NO: 795020 - protein, 140 aa, Homo sapiens
  misc_feature: NA.10.12.B01.1.454.light.4.nb-aa
MAWIPLLLPLLTLCTGSEASYELTQPPSVSVSPGQTARITCSGDALPKQYAYWYQQKPGQAPVELVYKDTERPPGIPERFSGSSSGTTVTLTISGARAEDEADYYCQSQDITGTYWVFGGGSKLTVLGQPKAAPSVTLFP

SEQ ID NO: 795021 - protein, 139 aa, Homo sapiens
  misc_feature: NA.10.17.B06.1.454.light.4.nb-aa
MEAPAQLLFLLLLWLPDTTGEVVMTQSPATLSVSPGERVTLSCRASQTISTNLAWYQHKPGQAPRLLIHGASSRATNIPARFSGSGSGSEFTLTISSLQSEDFAVYYCQQYDTWPPYTFGRGTKLEIKRTVAAPSVFIP

SEQ ID NO: 795022 - protein, 138 aa, Homo sapiens
  misc_feature: NA.10.21.B10.1.454.light.4.nb-aa
MEAPAQLLFLLLLWLPDTTGEIVLTQSPATLSLSPGERATLSCRASQSVRTSLGWYQHKSGQAPRLLIFDAFNRAPGVPGRFSGSGSGTDFTLTISSLEPEDFAVYYCQQRATFGGGATFGGGTKIEVKRTVAAPSVF

SEQ ID NO: 795023 - protein, 136 aa, Homo sapiens
  misc_feature: NA.10.25.C03.1.454.light.4.nb-aa
MEAPAQLLFLLLLRLPETTGEIVMTQSPATLSASPGQTATLSCWASPSVGSRLAWYQQKPGQPPRLLVYGASTRATGIPARFSGSGSGTEFALTISSLQSEDFAVYYCQEYDGWPPYTFGQGTKLDIKRTVAAPSV

SEQ ID NO: 795024 - protein, 149 aa, Homo sapiens
  misc_feature: NA.10.27.C05.1.454.light.4.nb-aa
MAWALLLLTLLTQDTGSWALSALTQPASVSGSPGQSVTISCTGPSTDVGHYNLVSWYQQRPDKAPTLLIYEVSKRPSGVSSRFSASKSGNTASLTISGLQADDEAEYYCSSYVDGASFKVFGGGTRLTVLSQPKAAPSVTLFPPSSTTM

SEQ ID NO: 795025 - protein, 139 aa, Homo sapiens
  misc_feature: NA.10.29.C07.1.454.light.4.nb-aa
MAWALLFLTLLTQGTGSWAQSALTQPASVSGSPGQSITISCTGTSSDVGGYNYVSWYQQHPGKAPKLMIFDVSNRPSGVSNRFSGSKSGNTASLTISGLQAEDEADYYCSSYTTSSTSVFGGGTKLTVLGQPKAAPSVT

SEQ ID NO: 795026 - protein, 139 aa, Homo sapiens
  misc_feature: NA.10.33.C11.1.454.light.4.nb-aa
MDMRVPAQLLGLLLLWLSGVRCDIQMTQSPSSLYASVGDSVTITCRASQDIYKSLNWYQQKPGKAPKLLIYDASNLETGVPSRFSGGGSGTDFTLGIRSLQPEDFATYYCQQYENVPLTFGGGPKVEFKRTVAAPSVFI

SEQ ID NO: 795027 - protein, 138 aa, Homo sapiens
  misc_feature: NA.10.36.D03.1.454.light.4.nb-aa
MAGFPLLLTLLTHCAGSWAQSVLTQPPSASGTPGQRVTISCSGSSSNVGRDNVYWYQQVPGTAPKLLIYNDYRRPSGVPDRFSGSKSGTSASLAISGLRSEDDADYYCVAWDDSLSAYVFGTGTKVTVLRQPKANPTV

SEQ ID NO: 795028 - protein, 137 aa, Homo sapiens
  misc_feature: NA.10.37.D04.1.454.light.4.nb-aa
MEAPAQLLFLLLLWLPDSTGEIVLTQSPATLSVTPGERATLSCRASQGISSNLAWYQQKPGQVPRLLIYEASSRATGVPARFSGGGSGTDFTLTISSLQSEDLGVYYCQQYHNWPPWTFGQGTKVDLKRTVAAPSVF

SEQ ID NO: 795029 - protein, 147 aa, Homo sapiens
  misc_feature: NA.10.38.D05.1.454.light.4.nb-aa
WVWALLLLTLLTQGTGSWAQSALTQPPSASGSPGQSVTISCTGTSSDFVAYNYVSWYQHHPGKAPKLLVFEVSKRPSGVPDRFSASKSGNTASLTVSGLQAEDEADYYCSAYSGPNRVFGGGTKVTVLGQPKAAPSVTLFPPSSTTM

SEQ ID NO: 795030 - protein, 140 aa, Homo sapiens; identical to SEQ ID NO: 794995
  misc_feature: NA.10.43.D10.1.454.light.4.nb-aa

SEQ ID NO: 795031 - protein, 142 aa, Homo sapiens
  misc_feature: NA.10.65.F10.1.454.light.4.nb-aa
MDMRVPAQLLGLLLLWLRGARCDIQMTQSPPSLSAFVGDRVTISCRTSQNIDTYLNWYQQKLGKAPTLLINAASSLQSGVPSRFSGSGSGTDFTLTISDLQPDDFATYYCQQSFRNPVTFGGGTKVEIKRTVAAPSVFIFPA

SEQ ID NO: 795032 - protein, 141 aa, Homo sapiens
  misc_feature: NA.10.71.G05.1.454.light.4.nb-aa
MEAPAQLLFLLLLWLPDTTGEIVLTQSPATLSLSPGERATLSCRASQSVRTSLGWYQHKSGQAPRLLIFDAFNRAPGVPGRFSGSGSGTDFTLTISSLEPEDFAVYYCQQRATFGGGATFGGGTKIEVKRTVAAPSVFIFP

SEQ ID NO: 795033 - protein, 133 aa, Homo sapiens
  misc_feature: NA.10.74.G08.1.454.light.4.nb-aa
MEAPAQLLFLLLLWLPDTTGEIVMTQSPATLSVSPGEGATLSCRASQSISSNLAWYQQKPGQSPRLLLYDASTRATGIPARFSGSGSGTEFTLTISSLQSEDIAVYYCQQYTNWPLTFGQGTRVEIKRTVAAP

SEQ ID NO: 795034 - protein, 143 aa, Homo sapiens
  misc_feature: NA.10.75.G09.1.454.light.4.nb-aa
MAWALLFLTLLTQGTGSWAQSALSQPASVSGSPGQSITISCNGSESDIGSLNFVSWYQQSPDKAPKIIISAVSNRPSGVSSRFSGSKSGNTASLTISGLQAEDEADYYCSSYTNTKALIFGGGTKLTVLRQPKAAPSVTLFPP

SEQ ID NO: 795035 - protein, 137 aa, Homo sapiens
  misc_feature: NA.10.79.H02.1.454.light.4.nb-aa
METPAQLLFLLLLWLPDTTGEIVLTQSPGTLSLSPGERATLSCRASQSLSSNYVAWYQQKPGQAPGLLIYGTSSRATGIPDRFSGSGSGTDFTLTISRLESEDFAVYYCQQYGRSPGTFGQGTKLEIKRTVAAPSVF

SEQ ID NO: 795036 - protein, 148 aa, Homo sapiens
  misc_feature: NA.10.86.H09.1.454.light.4.nb-aa
MTCSPLLLSLLIHCTGSWAQSLLTQPPSVSAAPGQRVTVSCSGSASNIGTNYVSWYQHFPGTAPKLLIYEDFTRPSGIPGRFSGSKSGTSATLDITGLQTGDEADYYCATWDSNLTVGAFGGGTKLTVLRQPKAAPSVTLFPPSSTTM

SEQ ID NO: 795037 - protein, 149 aa, Homo sapiens
  misc_feature: NA.10.9.A09.1.454.light.4.nb-aa
MEAPAQLLFLLLLWLPVSDTTGEIVLTQSPATLSLSPGERATLSCRASQNVGAFVSWYQHKPGQAPRPLIYGASNRATGIPARFSGSGYGTDFTLTIISLEPEDVAVYYCQHRTEWPPGATFGPGTKVEIKRTVAAPSVFIFPPSDTTM

SEQ ID NO: 795038 - protein, 134 aa, Homo sapiens
  misc_feature: NA.11.12.B01.1.454.light.4.nb-aa
MAWIPLFLGVLAYCTESMASYELTQPPSMSVSPGQTATISCSGDVLTNEYASWYQQKAGQPPVLLIFQNTRRPSGVPERFSGSGSGNTVTLTISGTQAIDEAVYFCQAWDNSVVFGGGTSLTVLGQPKAAPSVT

SEQ ID NO: 795039 - protein, 138 aa, Homo sapiens
  misc_feature: NA.11.21.B10.1.454.light.4.nb-aa
MEAPAQLLFLLLLWLPDSTGEIVLTQSPATLSLSPGERATLSCRASQSVNSYLAWYQQKPGQTPRLLIYDASNRATGTPARFSGSGSGTDFTLTISSLEPEDFAVYYCQQRIDWITFGQGTRLEIKRTVAAPSVFIFP

SEQ ID NO: 795040 - protein, 137 aa, Homo sapiens
  misc_feature: NA.11.60.F05.1.454.light.4.nb-aa
MEAPAQLLFLLLLWLPDTTGEIVMTQSPATLSVSPGERATLSCRASQSISSNLAWYQQKPGQAPRLLFYGASNRAAGIPARFSGSGSATEFTLTISSLQSEDFAVYYCQQYNDWPPTWTFGQGTKVEIKRTVAAPSV

SEQ ID NO: 795041 - protein, 148 aa, Homo sapiens
  misc_feature: NA.11.67.G01.1.454.light.4.nb-aa
MASFPLLLTLLTHCAGSWAQSVLTQPPSASGTPGQRITISCTGSSSNIGSNDVNWYQHLPGTAPKLLIYRNSQRPSGVPGRFSGSKSGTSASLACSGLQSEDEADYYCAAWDDGLSAVVFGGGTKLTVLGQPKAAPSVTLFPPSSYLS

SEQ ID NO: 795042 - protein, 143 aa, Homo sapiens
  misc_feature: NA.11.75.G09.1.454.light.4.nb-aa
MAWSPLLLTLLAHCTGSWAQSALTQPPSVSGAPGQRVAISCTGSTSNIGAGYGMLWYQQRPGMAPKLLIYADNNRPSGVPDRFSGSKSGSSASLAITGLEADDEADYYCLSYDDDLQTPVFGGGTKLTVLSQPKAAPSVTLFP

SEQ ID NO: 795043 - protein, 147 aa, Homo sapiens
  misc_feature: NA.12.1.A01.1.454.light.4.nb-aa
MDMRVPAQLLGLLLLWLRGARCDIQMTQSPSSLSASVADRVTITCRASQTISSYLNWYQQKPGKAPKVLIYAASSLQSGVPSRFSGSGSGTDFTLTISSLQPEDSATYYCQQSNSYPPTFGGGTKVEIKRTVAAPSVSSSSRHLIRR

SEQ ID NO: 795044 - protein, 135 aa, Homo sapiens
  misc_feature: NA.12.10.A10.1.454.light.4.nb-aa
MDMRVPAQLLGLLLLWLPGARCDIQLTQSPSFLSASIGDRVTITCRASQDISNYLGWYQQKPGKAPNVLIYGASTLHSGVPSRFSGSGSGTEFTLTITSLQPEDFATYYCQQVYIYPRIFGPGTTVDIKRTVAAP

SEQ ID NO: 795045 - protein, 135 aa, Homo sapiens
  misc_feature: NA.12.11.A11.1.454.light.4.nb-aa
MAWALLLLTLLTQDTGSWAQSALTQPASVSGSPGQSITISCTGTSSDAGSDKFVSWYQHHPGKAPRLMIYEGKKRPSGISNRFSGSKSGNTASLTISGLQAEDEADYYCCSYAGSGTFALFGGGTKLTVLRQPKA

SEQ ID NO: 795046 - protein, 143 aa, Homo sapiens
  misc_feature: NA.12.21.B10.1.454.light.4.nb-aa
MAWALLLLTLLTQDTGSWAQSALTQPASVSGSPGQSITVSCTGTSNDFGNFDLVSWYQQYPGKVPKLIIYEGTKRPSGVSDRFSGSKAGDRASLTISGLQAEDEAHYYCCSYGGYSTWVFGGGTKVTVLSQPKAAPSVTLFPP

SEQ ID NO: 795047 - protein, 138 aa, Homo sapiens
  misc_feature: NA.12.37.D04.1.454.light.4.nb-aa
MDMRVPAQLLGLLLLWLPGARCDIQMTQSPSSLSASVGDRVTITCQASEDIRKFLNWFQQKPGKAPRLLIHEASNSEIGVPRRFSGGGAGTDFTLTISSLQPEDLATYYCQQYNNLPYTFGQGTKLEIKRTVAAPSVF

SEQ ID NO: 795048 - protein, 140 aa, Homo sapiens
  misc_feature: NA.12.48.E04.1.454.light.4.nb-aa
MASFPLLLTLLTHCAGSWAQSVLTQPPSASGTPGQRVTISCSGTHSNIGYNSVDWYQQLPGAAPRLLIFNNNQRPSGVPDRFSGSKSGTSASLAISGLQSEDEADYYCASWADTLTGPGVFGGGTKLTVLGQPKAAPSVT

SEQ ID NO: 795049 - protein, 141 aa, Homo sapiens
  misc_feature: NA.12.73.G07.1.454.light.4.nb-aa
MAWTVLLLGLLSHCTASVTSYVLIQSPSVSVAPGQTATITCGGDNIVTKSVHWYQQKPGQAPVVVVYDDSDRPSGIPERFSGSNSGNMATLTIRRVEAGDEADYYCQVWDNGSDHVLFGGGTTLTVLSQPKAAPSVTLFPP

SEQ ID NO: 795050 - protein, 140 aa, Homo sapiens
  misc_feature: NA.12.86.H09.1.454.light.4.nb-aa
MEAPAQLLFLLLLWLPGATGEILLTQSPATLSLSPGERATFSCRASQSLSTYLAWYQQKPGQAPRLLIYDASKRATGIPARFSGSGSGADFTLTISSLEPEDFAVYYCQQRSNWPRFTFGQGTKLEIKRTVAAPSVFISP

SEQ ID NO: 795051 - protein, 148 aa, Homo sapiens
  misc_feature: NA.13.23.C01.1.454.light.4.nb-aa
MASFPLLLTLLTHCAGSWAQSVLTQPPSASGTPGQRVTISCSESSSNTGTGDINWYQQLPGTAPKLLIYTNNHRPSGIPDRFSASKSGTSASLAISRLQSEDEADYYCAAYYDTLNGLWVFGGGTKLTVLGQPKAAPSVTLFPPSSST

SEQ ID NO: 795052 - protein, 139 aa, Homo sapiens
  misc_feature: NA.13.33.C11.1.454.light.4.nb-aa
MAWALLFLTLLTQGTGSWAQSALTQPASVSGSPGQSITISCTGTTSDIGDYNYVSWYQQCPGKAPKLIIFTVSHRPSGVSNRFSGSKSGNTASLTISGLQAEDEADYYCSSYTSGSSLYLFGGGTKVTVLSQPKANPCH

SEQ ID NO: 795053 - protein, 142 aa, Homo sapiens
  misc_feature: NA.13.77.G11.1.454.light.4.nb-aa
MAWTVLLLGLLSHCTGSVTSYVLTQPPSVSVAPGQTARITCGGNNIGSKSVHWYQQKPGQAPVLVVYVDSDRPSGIPERFSGSNSGNTATLTISRVEAGDEADYYCQAWDSSREHVVFGGGTKLTVLGQPKAAPSVTLFPAL

SEQ ID NO: 795054 - protein, 138 aa, Homo sapiens
  misc_feature: NA.13.87.H10.1.454.light.4.nb-aa
MDMRVPAQLLGLLLLWLPGARCDIQLTQSPSFLSASVGDRVTITCRASQDINSYLVWYQQKPGKVPKLLIYVASTLQSGVPSRFSGSGSGTEFTLTISSLQPEDFATYYCQQLNSYPLSFGGGTKVEIKRTVAAPSVF

SEQ ID NO: 795055 - protein, 141 aa, Homo sapiens
  misc_feature: NA.18.23.C01.1.454.light.4.nb-aa
MDTRVPAQLLGLLLLWLPGSRCDIQMTQSPSSVSASVGDRVTITCRANQDIKTWLVWYQQKPGKAPKLQMIGPSSFQDGAPSRFRVSGSGTDFTLTISSLQPEDFATYYCQQAHNFPLTFGGGTKVEIKRTVAAPSVFIFP

SEQ ID NO: 795056 - protein, 151 aa, Homo sapiens
  misc_feature: NA.19.71.G05.1.454.light.4.nb-aa
MVLQTQVFISLLLWISGAHGDIVMTQSPDSLAVSLGERATINCKSSHNLLYSSNNENYLAWYQQRPGQPPRLLIYWASTRESGVPDRFSGSGSGTDFTLTISSLQAEDVAVYYCQQYYYTSWTFGQGTKVDIRRTVAAPSVFIFPPSDTRV

SEQ ID NO: 795057 - protein, 148 aa, Homo sapiens
  misc_feature: NA.19.78.H01.1.454.light.4.nb-aa
MAWALLLLTLLTQDTGSWAQSALTQSASVSGSPGQSVTISCTGTSSDVGNSNLVSWYQHHPNKAPKLIIYDATKRPSGVSNRFSGSKSGNTASLTISGLQAEDEADYYCCSYAGRISYVFGTGTKVTVLGQPKANPTVTLFPPSSTRV

SEQ ID NO: 795058 - protein, 139 aa, Homo sapiens
  misc_feature: NA.19.85.H08.1.454.light.4.nb-aa
MPWALLLLTLLTHSAVSVVQAGLTQPPSVSGGLGQAATVTCTGNTNNVGDQGAAWLQQRQGHPPKLLSYRNDNRPSNISERFSTSRTQNTASLTITGLQPDDEADYYCSAWDTSLAAWLFGGGTKLTVLGQPKAAPSVT

SEQ ID NO: 795059 - protein, 135 aa, Homo sapiens
  misc_feature: NA.21.12.B01.1.454.light.4.nb-aa
MAWALLFLTLLTQGTGSWAQSALTQPASVSGSPGQSITISCTGTSGDVGLYDYVSWYQQYPGKAPKLIIYDVSNRPSGVSNRFSGSKSGNTASLTISGLQADDEADYYCRSYTISNTYVFGTGTKITVLGQPKAN

SEQ ID NO: 795060 - protein, 150 aa, Homo sapiens
  misc_feature: NA.21.25.C03.1.454.light.4.nb-aa
MAWSPLLLTLLAHCTGSWAQSVLTQPPSVSGAPGQTVTISCAGSSSNIGSPFDVHWYQQLPGTAPKLLIYGNSNRPSGVPDRFSGSKSGTSASLVIAGLQADDEADYYCQSYDNTLRGFWLFGGGTKLTVLGQPKAAPSVTLFPPSSERR

SEQ ID NO: 795061 - protein, 139 aa, Homo sapiens
  misc_feature: NA.21.38.D05.1.454.light.4.nb-aa
METPAQLLFLLLLWLPGVTGEVVLTQSPGTLSLSPGERVTLSCKASQSVGIDVAWYQQKPGQAPSLLIYGASYRMTGIPDRFSASGSGTDFTLTINTLAPEDFAVYYCQMYGRSPYTFGQGTKVEIRRTVAAPSVFIFP

SEQ ID NO: 795062 - protein, 137 aa, Homo sapiens
  misc_feature: NA.21.55.E11.1.454.light.4.nb-aa
MDMRVPAQLLGLLLLWLRGARCDIQMTQSPSSLSASVGDRITIICRTSHDINTFLNWYQHKPGKAPKLLIDAASNLESGVPSRFSGDGSGTNFTLTISSLQPEDFATYYCQQSYSIPFTFGPGTEVDIKRTVAAPSV

SEQ ID NO: 795063 - protein, 136 aa, Homo sapiens
  misc_feature: NA.21.65.F10.1.454.light.4.nb-aa
MEAPAQLLFLLLLWLPESSGEIVMTQSPATLSVSPGERATLSCRASQSVSSNLAWYQQKPGQPPRLLIYGASARATGIPARFSGTGSGTEFTLTISSLQSEDFEVYFCLQYNQWPRTFGQGTKVEIKRTVAAPSVF

SEQ ID NO: 795064 - protein, 149 aa, Homo sapiens
  misc_feature: NA.21.87.H10.1.454.light.4.nb-aa
MAWALLLLTLLTQGTGSWAQSALTQPASVSGSPGQSVTISCAGSSDDIGRFNLVSWYQQHQDKAPKLLISGVNQRPSHVSSRFSASKSGNTAFLTISQLQAEDEAIYYCSSYAGGTFFLVFGGGTQMTVLSQPKAAPSVTLFPPSSERR

SEQ ID NO: 795065 - protein, 139 aa, Homo sapiens
  misc_feature: NA.21.9.A09.1.454.light.4.nb-aa
MDMRVPAQLLGLLLLWLPGAKCDIQMTQSPSTLSASVGGRVSITCRASQNIYSWLAWYQQKPGKAPNLLIYRASNLESGVPSRFSGSGSGTEFTLTISGLQPDDFATYYCQHYNDYSRTFGQGTRVEIKRTVAAPSVFI

SEQ ID NO: 795066 - protein, 139 aa, Homo sapiens
  misc_feature: NA.22.14.B03.1.454.light.4.nb-aa
MVLQTQVFISLLLWISGAYGDIVMTQSPDSLAVSLGERATINCKSSQSIFYSSTNKSYLAWFQQKPGHRPALLIYWASTRESGVPDRFSGSGSGTDFTLTISSLQAEDVAVYYCQQYYIPPQTFGQGTKVEIKRTVAAP

SEQ ID NO: 795067 - protein, 138 aa, Homo sapiens
  misc_feature: NA.22.15.B04.1.454.light.4.nb-aa
MAWALLLLSLLTQGTGSWAQSALTQPPSASGSPGQSVTISCTGTSSDVGGYNYVSWYQQHPGKAPKLMIYEVTKRPSGVPDRFSGSKSGNTASLTVSGLQAEDEADYYCSSYGGSDNLVFGGGTKLTVLGQPKAAPSV

SEQ ID NO: 795068 - protein, 140 aa, Homo sapiens
  misc_feature: NA.22.21.B10.1.454.light.4.nb-aa
MAWALLLLSLLTQGTGSWAQSALTQPPSASGSPGQSVTISCTGTSSDVGGYKYVSWYQHHPGTAPKLMIYEVTKRASGVPDRFSGSKSGDTASLTVSGLQAEDEADYYCYSYAGGNSWVFGGGTKLTVLGQPKAAPSVTL

SEQ ID NO: 795069 - protein, 139 aa, Homo sapiens
  misc_feature: NA.22.38.D05.1.454.light.4.nb-aa
MEAPAQLLFLLLLWLPDTTGEIVLTQSPATLSLSPGERATLSCRASQNVSSYLAWYQQKPGQAPRLLISDTSNRATGIPARFSGSGSGTDFTLTISDLEPEDFAVYYCQQRSIWPPYTFGQGTKLEIKRTVAAPSVFIF

SEQ ID NO: 795070 - protein, 139 aa, Homo sapiens
  misc_feature: NA.22.5.A05.1.454.light.4.nb-aa
MEAPAQLLFLLLLWLPETTGEVVLTQSPATLSLSPGERATLSCRASQSVNYYLAWYQQKPGQAPRLLIYDASYRATGIPARFSGSGSGTDFTLTISSLEPEDFAVYYCQQRSNSLTFGGGTKVEIKRTVAAPSVFIFPP

SEQ ID NO: 795071 - protein, 141 aa, Homo sapiens
  misc_feature: NA.22.57.F02.1.454.light.4.nb-aa
MDMRVPAQLLGLLLLWLPGAKCDIQMTQSPSTLAASVGDRVTITCRASQNINSWLAWYQQKPGKAPILLIHKASTLESGVPSRFSGTGSGTEFTLTINSLQPDDLATYYCQPYSTYSVTFGQGTRLEIKRTVAAPSVFILP

SEQ ID NO: 795072 - protein, 134 aa, Homo sapiens
  misc_feature: NA.22.6.A06.1.454.light.4.nb-aa
MAWIPLLLPLLTLCTDSEAAYELTQPPSVSVSPGQTARITCSGDALPNQYAFWYQQRPGHAPVLMIYKDSERPSGISERFSASSSGTTFTLTISEVQAEDEADYYCQSTDSSGKYVVFGGGTKLTVLGQPKAAP

SEQ ID NO: 795073 - protein, 136 aa, Homo sapiens
  misc_feature: NA.22.65.F10.1.454.light.4.nb-aa
MDMRVPAQLLGLLLLWLRGARCDIQMTQSPSSLSASVGDRVTITCRASQSITYYLNWYQQKPGKAPKLLIYATSSLQSGVPSRFSGSGSGTDFTLTIRGLQPEDFATYYCQQTYSAPPITFGQGTRLEIKRTVAAP

SEQ ID NO: 795074 - protein, 137 aa, Homo sapiens
  misc_feature: NA.22.73.G07.1.454.light.4.nb-aa
MEAPAQLLFLLLLWLPDTTGEIVMTQSPATLSVSPGERATLSCRASQSVSNNLVWYQQRPGQAPRLLIYGASTRATGIPARFSASGSGTEFTLTISSLQSEDFALYYCQQYNDWFSITFGQGTRLEIKRTVAAPSVL

SEQ ID NO: 795075 - protein, 149 aa, Homo sapiens
  misc_feature: NA.22.87.H10.1.454.light.4.nb-aa
MAWSPLLLTLLAHCTGSWAQSVLTQPPSISGAPGQKVTISCTGYNSNIGAYNDVHWYQQLPETAPKLLIYGNNNRPSGVPDRFSGSKSGMSASLAITGLQAEDEADYFCQSYDNSLGAVVFGGGTKLTVLGQPKAAPSVTLFPPSSRVC

SEQ ID NO: 795076 - protein, 139 aa, Homo sapiens
  misc_feature: NA.22.9.A09.1.454.light.4.nb-aa
MEAPAQLLFLLLLWLPETTGEVVLTQFPATLSLSPGERATLSCRANESISDYLAWYQQRPGQAPRLLMYDASKRATGIPARFSGSGSGRDFTLTINSLEPDDSAVYYCQQRTKWPPTFGQGAKLEIRRTVAAPSVFIFP

SEQ ID NO: 795077 - protein, 137 aa, Homo sapiens
  misc_feature: NA.26.23.C01.1.454.light.4.nb-aa
MDMRVPAQLLGLLLLWLPGVKCDIQMTQSPSRLSASVGDRVTITCRASQSIGRWLAWYQQKPGTIPKILISQASGLESGVPSRFSGAGSGTEFTLTISGLQSEDSATYYCQQYDIYSPAFGQGTKVEVKRTVAAPSV

SEQ ID NO: 795078 - protein, 135 aa, Homo sapiens
  misc_feature: NA.26.55.E11.1.454.light.4.nb-aa
MDMRVPAQLLGLLLLWLRGARCDIQMTQSPSSLSASVGDRVTITCRASEGINKFLNWYQEKPGRAPKVLIYGASILQSGVPPNFSGSGSGTDFTLSINNLQPEDFATYYCQQSYRPPYTFGQGTKLEITGTVAAP

SEQ ID NO: 795079 - protein, 135 aa, Homo sapiens
  misc_feature: NA.27.78.H01.1.454.light.4.nb-aa
MLPSQLIGFLLLWVPASRGEIVLTQSPDFQSVTPKEKVTITCRASQSVGSSLHWYQQKPGQSPKLLIKYASQSFSGVPSRFSGSGSGTHFTLTINSLEAEDAATYYCHQSTTLPQVITFGQGTRLEIKRTVAAPS

SEQ ID NO: 795080 - protein, 136 aa, Homo sapiens
  misc_feature: NA.46.35.D02.1.454.light.4.nb-aa
METPAQLLFLLLLWLPETTGEVVLTQSPGTLSLSPGERATLSCRASHYVSDNYLAWLQHKPGQAPRLLIYAASIRATGIPGRFSGSGSGTDFTLTISRLEPEDFAVYYCQQYGHVPRTFGQGTKLEIKRTVAAPSV

SEQ ID NO: 795081 - protein, 141 aa, Homo sapiens
  misc_feature: NA.47.23.C01.1.454.light.4.nb-aa
MAWTVLLLGLLSHCTDSVASYVLTQPSSVAVAPGQTARIPCGGNNIGSKSVHWYQQRPGQAPVLVVHDDSDRPSGIPERFSGSNSGNTATLTISAVEAGDEADYYCQVWDSNSDPEQVFGGGTKLTVLSQPKAAPSVTLFP

SEQ ID NO: 795082 - protein, 144 aa, Homo sapiens
  misc_feature: NA.47.53.E09.1.454.light.4.nb-aa
MAWTVLLLGLLSHCTGSVTSDELIQAPSMSVAPGQTARITCAGASVGERSVHWYQQMPGQAPVLVVYDDSDRPSGIPERFSGSKSGNTATLTVSRVDVGDEAVYFCQVWETNFGHMLFGGGTKLTVLGQPKAAPSVTLFPPSST

SEQ ID NO: 795083 - protein, 136 aa, Homo sapiens
  misc_feature: NA.47.62.F07.1.454.light.4.nb-aa
LDMRVPAQLLGLLLLWLSGARCDTQMTQSPSSLSASVGDRVTITCQASQDISNYLNWYQQKPGKAPKLLIYDASNLETGVPSRFSGSGSGTDFTFTISSLQPEDIATYYCQQYHNLPTFGPGTKVDIKRTVAAPSV

SEQ ID NO: 795084 - protein, 139 aa, Homo sapiens
  misc_feature: NA.47.64.F09.1.454.light.4.nb-aa
MEAPAQLLFLLLLWLPDTIGEVVLTQSPATLSLSPGERATLSCRASQNIHSYLAWYQQKPGQAPRLLIYDASNRATGIPDRFSGSGSGTDFTLTISSLEPEDFGLYYCQQREFWPPLTFGGGTRVEIKRTVAAPSVFIP

SEQ ID NO: 795085 - protein, 139 aa, Homo sapiens
  misc_feature: NA.47.65.F10.1.454.light.4.nb-aa
MASFPLLLTLLTHCAGSWAQSALTQPPSVSGTPGQTVAVSCSGSGSNIGRNSVNWYQQLPGMAPTLLIYRDDQWPSGVPDRFSGSKSGTSASLAISGLQSGDEADYYCATWDDSLNAMVFGGGTKVAVLGQPKAAPSVT

SEQ ID NO: 795086 - protein, 142 aa, Homo sapiens
  misc_feature: NA.47.82.H05.1.454.light.4.nb-aa
MAWTALLLSLLAHFTVSVASFDLTQPLSVSVALGQTARLTCGGINIGRKNVHWYQQKPGQAPVLVIYKDTNRPSGIPERFSGSNSDNTATLTISRAQVGDEADYFCQIWDISAAVFGAGTKLTVLSQPKAAPSVTLFPPSST

SEQ ID NO: 795087 - protein, 148 aa, Homo sapiens
  misc_feature: NA.47.85.H08.1.454.light.4.nb-aa
MAWALLLLTLLTQGTGSWAQSAPTQPASVSGSPGQSITISCTGTSSDVGSSDSISWYQQHPGKAPKLIIYDVNVRPSGVSHRFSGSKSGNTASLTISGLESEDEADYFCCSWATTVVWVFGGGTKLTVLGQPKAAPSVTLFPTLLYVS

SEQ ID NO: 795088 - protein, 146 aa, Homo sapiens
  misc_feature: NA.40.11.A11.1.454.light.4.nb-aa
MVLQTQVFIFLLLWISGAYGDIVMTQSPDSLAVSLGERATINCKSSQSLLYNSNKQHYLAWYQQKPGQPPKLLIYWASTRESGVPDRFSGSGSGTDFTLTISSLQAEDVAVYYCQQYYIIPRTFGQGTKVEIKRTVAAPSVFIFPP

SEQ ID NO: 795089 - protein, 143 aa, Homo sapiens
  misc_feature: NA.40.12.B01.1.454.light.4.nb-aa
MAWALLLLTLLTQGTGSWAQSALTQPPSASGSPGQSVTISCTGTSSDVGGYNYVSWYQLHPGKAPKLMISDVSKRPSGVPDRFSGSKSGNTASLTVSGLQAEDEADYYCYSYAGGNNWVFGGGTKLTVLGQPKAAPSVTLFPP

SEQ ID NO: 795090 - protein, 142 aa, Homo sapiens
  misc_feature: NA.40.16.B05.1.454.light.4.nb-aa
MAWALLLLSLLTQGTGSWTQSALTQPRSVSGSPGQSVTLSCTGTSSNVGGYNFVSWYQHHPGKAPKFLIYDVNKRPSGVPDRFSGSKSGNTASLTISGLQAEDEADYYCCSFAGSFWVFGGGTKLTVLGQPKAAPSVTLFPP

SEQ ID NO: 795091 - protein, 138 aa, Homo sapiens
  misc_feature: NA.40.20.B09.1.454.light.4.nb-aa
MAWIPLFLGVLAYCTGSVASSELTQPPSVSVSPGQTASITCSGDDLNNKHACWYQQKPGQSPVLVIFEDSKRPSGIPERFSGSKSALTATLTISGTQPMDEADYYCQSWDSSTSSYVFGTGTQVTVLGQPKANPTVTL

SEQ ID NO: 795092 - protein, 141 aa, Homo sapiens
  misc_feature: NA.40.4.A04.1.454.light.4.nb-aa
MVLQTQVFISLFLWISGAFGDIVMTQSPDSLALSLGERATINCKSSQSVLSTSYNQNYLAWYQHKPGQPPRLLIYWTSIRESGVPDRFRGSGSGTDFTLTITSLQAEDVAVYYCHQYLDIPPTFGQGTKVEIKRTVAAPSV

SEQ ID NO: 795093 - protein, 144 aa, Homo sapiens
  misc_feature: NA.40.46.E02.1.454.light.4.nb-aa
MAWTVLLLGLLSHCTGSVTSYVLTQPLSVSVAPGQAANVTCGGDNIGSKSVHWYQLKPGQAPVLVVFGHGARPSGIPERFSASRSGNTATLTITRVEAGDEADYFCHVWHVSHHVFGTGTTVTVLSQPKANPTVTLFPPSSVAR

SEQ ID NO: 795094 - protein, 135 aa, Homo sapiens
  misc_feature: NA.40.54.E10.1.454.light.4.nb-aa
MAWIPLLLPLLTLCTGSEASYELTQPPSVSVSPGQTASITCSGDSLSKQYAYWYQQKPGQAPVVVLYKDTERPSGTPERFSGSRSGTTVTLTISGVQAEDEADYYCQSADSSGTFRVFGGGTKLTVLGQPKAAPS

SEQ ID NO: 795095 - protein, 146 aa, Homo sapiens
  misc_feature: NA.40.60.F05.1.454.light.4.nb-aa
METPAQLLFLLLLWLPETPGEIVLTQSPGTLSLSPGERATLSCRASQSVTNNYLMWYQQKPGQAPRLLIYGASNRASGIPDRFRGSGADTDFTLTISRLEPEDFALYYCHQSAHVPLTFGGGTKVEIKRTVAAPSVFIFPPSEVAR

SEQ ID NO: 795096 - protein, 151 aa, Homo sapiens
  misc_feature: NA.40.8.A08.1.454.light.4.nb-aa
MVLQTQVFISLLLWISGANGDIVMTQSPDSLAVSLGERATINCKSSQTVLYSSNNENYVAWYQQKPGQPPKLLIYWASTRASGVPDRFSGSGSGTDFTLTINNLQAEDVAVYYCQQYYTTPLTFGGGTKVEIRRTVAAPSVFIFPPSEVAR

SEQ ID NO: 795097 - protein, 137 aa, Homo sapiens
  misc_feature: NA.40.80.H03.1.454.light.4.nb-aa
MEAPAQLLFLLLLWLPDTAGEIVLTQSPATLSLSPGERAILSCRASQNIDTYLAWYQQKPGLAPRVLIHDASHRATGIPHRFSGSGSGTDFSLTISSLEPEDFAIYFCQQRSTWPRVTFGQGTRLDMKRTVAAPSVF

SEQ ID NO: 795098 - protein, 139 aa, Homo sapiens
  misc_feature: NA.41.16.B05.1.454.light.4.nb-aa
MEAPAQLLFLLLLWLPDTTGDIVMTQSPATLSVSPGETATLSCRASQSVSNNLAWYQQKPGQAPRLLIYRASTRATGIPARFSGVGSGTEFTLTITSLQSEDFAVYYCHQYNNWYTFGQGTKLEIKRTVAAPSVFIFPP

SEQ ID NO: 795099 - protein, 135 aa, Homo sapiens
  misc_feature: NA.41.23.C01.1.454.light.4.nb-aa
MAWIPLLLPLLTLCTGSVTSYELTQPPSVSVSPGQTARIDCSGEALATEYAYWYQQKPGQAPMLIIYRDSERPSGIPERMSGSSSGTTVTLTITGVQAEDEADYHCQSADSSGSYWVFGGGTKLTVLGQPKAAPS

SEQ ID NO: 795100 - protein, 144 aa, Homo sapiens
  misc_feature: NA.41.42.D09.1.454.light.4.nb-aa
MEAPAQLLFLLLLWLPDVTGEIVMTQSPATLSVSPGERATLSCRASQSLSGTLAWYQQKPGQAPRLLIYGTSTRVTGVPARFSGSGSGTEFTLTISSLQSEDFAIYYCHHYNNWPSAWTFGQGTKVEIKRTVAAPSVFIFPPSE

SEQ ID NO: 795101 - protein, 137 aa, Homo sapiens
  misc_feature: NA.41.5.A05.1.454.light.4.nb-aa
MDMRVPAQLLGLLLLWFPGSRCDIQLTQSPSSVSASVGDRVNITCRASQGITSWLAWYQQKPGKAPKLLIYAASSLQSGVPSRFRGSGSGTDFTLTINSLQPEDFATYYCQQADSFPFTFGQGTRLDIKRTVAAPSV

SEQ ID NO: 795102 - protein, 135 aa, Homo sapiens
  misc_feature: NA.41.68.G02.1.454.light.4.nb-aa
MDMRVPAQLLGLLLLWLSGARCDIQMTQSPTSLSASVGDRVTITCQASQDISNYLNWYQQKPGKAPKLLIYDASNLESGVPSRFSGSGSGTDFTFTITSLQPEDIATYYCQQYDNLPPTFGGGTKVEIKRTVAAP

SEQ ID NO: 795103 - protein, 139 aa, Homo sapiens
  misc_feature: NA.43.10.A10.1.454.light.4.nb-aa
MAWTPLWLTLLTLCIGSVVSSELTQDPAVSVALGQTVRITCQGDSLKYYYASWYQQKPRQAPILVIYGKNNRPSGIPDRFSGSSSGNTASLTITGAQAEDEADYYCNSRDSNGDLYVFGTGTKVTVLGQPKANPTVTLF

SEQ ID NO: 795104 - protein, 135 aa, Homo sapiens
  misc_feature: NA.43.12.B01.1.454.light.4.nb-aa
MDMRVPAQLLGLLLLWFPGSRCDIQLTQSPSSVSASVGDTVTITCRASQVISNWLAWYQQKPGKAPKLLIYAASRLQSGVPSRFSGSGSGTDFTLTISSLQPEDFATYYCQQADSFPFTFGQGTRLDIKRTVAAP

SEQ ID NO: 795105 - protein, 141 aa, Homo sapiens
  misc_feature: NA.43.15.B04.1.454.light.4.nb-aa
MEAPAQLLFLLLLWLPETTGEIVMTQSPATLSLSPGERATLSCRASQSVSTNVAWYQQKPGQPPRLLISGASSRATGSPARFSGSGSGTEFTLTISSLQSEDFAVYYCHQYHNWPPRGTFGQGTKVEFNRTVAAPSVFIFP

SEQ ID NO: 795106 - protein, 141 aa, Homo sapiens
  misc_feature: NA.43.16.B05.1.454.light.4.nb-aa
MDMRVPAQLLGLLLLWLRGARCDIQMTQSPSSLSASVGDRVNITCRASQTINTHLNWYQQKRGKAPKLLIYVASTLQTGVPSRFSGSGSGADFTLNIGSVQPEDFATYYCQQSHSFPYTFGQGTRLESKRTVAAPSVFIFP

SEQ ID NO: 795107 - protein, 144 aa, Homo sapiens
  misc_feature: NA.43.19.B08.1.454.light.4.nb-aa
MAWTVLLLGLLSHCTGSVTSYVLTQPPSVSVAPGKTARITCGGTNIGRRSVHWYQQKPGQAPLMIVYDDSDRPSGIPERVAGSNSGNTATLAISRVEAGDEADYYCQVWDNGGDHPVFGGGTKLTVLSQPKAAPSVTLFPPSSL

SEQ ID NO: 795108 - protein, 137 aa, Homo sapiens
  misc_feature: NA.43.20.B09.1.454.light.4.nb-aa
METPAQLLFLLLLWLPDTTGEIVLTQSPGTLSLSPGDRATLSCRASQSVSSTYLAWYQQKPGQAPRLLIYDASSRATGIPDRFSGSGSGTDFTLTISRLEPEDFAVYYCHQYGSSPKTFGQGTKVEIKRTVAAPSVF

SEQ ID NO: 795109 - protein, 145 aa, Homo sapiens
  misc_feature: NA.43.29.C07.1.454.light.4.nb-aa
MDMRVPAQLLGLLLLWLPGARCAIQLTQSPSSLSASVGDRVTITCRASQGIGTALAWYLQNPGKAPKLLISGASTLESGVPSRFSGSGSGTEFTLTVSSLQPEDFATYYCQQFNNYPLTFGGGTRVEIKRTVAAPSVFIFPPSEL

SEQ ID NO: 795110 - protein, 145 aa, Homo sapiens
  misc_feature: NA.43.5.A05.1.454.light.4.nb-aa
MAWTPLFLFLLTCCPGSNSQAVVTQEPSLTVSPGGTVTLTCGSSTGTVTSGHYPYWFQQKPGQAPRTLIYDTSNKLSWTPARFSGSLLGGKAALTLSGAQPEDEADYYCLLAYDAARVFGGGTKLTVLGQPKAAPSVTLFPPSSL

SEQ ID NO: 795111 - protein, 148 aa, Homo sapiens
  misc_feature: NA.43.57.F02.1.454.light.4.nb-aa
LAWALLLLTLLTQGTGSWAQSALTQPPSASGSPGQSVTISCTGSSSDIGGYTYVSWYQQHPGKAPKLMIYEVNKRPSGVPDRFSGSKSGNTATLTVSGLQAEDEAHYYCSSYTGNKNLVFGGGTELTVLGQPKAAPSVTLFPPSSLLT

SEQ ID NO: 795112 - protein, 141 aa, Homo sapiens
  misc_feature: NA.43.6.A06.1.454.light.4.nb-aa
MMLQTQIFISLLLWISGVPGDIVLTQAPASLSLSLGERAVITCSSNQGLSYNLYEYLAWFQQRPGRSPRLLLSGACHREAGVPDRFSGGGSGRNFTLTISALETDDVATYYCQQCYGVPITFGGGPRIDIRRTVAAPSVFI

SEQ ID NO: 795113 - protein, 136 aa, Homo sapiens
  misc_feature: NA.43.61.F06.1.454.light.4.nb-aa
METPAQLLFLLLLWLPDATGAIVLTQSPGTLSLSPGETATLSCRASQSVREDYLAWYQQKPGQAPRLLINGASSRATGIPDRFSGSGSATDFTLIISRLEPEDFAVYFCQQYGSSPYTFGQGTKLEIKRTVAAPSV

SEQ ID NO: 795114 - protein, 141 aa, Homo sapiens
  misc_feature: NA.43.62.F07.1.454.light.4.nb-aa
MDMRVPAQLLGLLLLWLRGARCDIQLTQSPSSLSASVGDRLTITCRASQTIRTYLNWYQENPGKAPKLLIYATSTLQSGVPSRFSGSGSGTHFTLTISSLQPEDYATYFCQQSDRNPWTFGQGTKVESKRTVAAPSVFIFP

SEQ ID NO: 795115 - protein, 137 aa, Homo sapiens
  misc_feature: NA.43.63.F08.1.454.light.4.nb-aa
MDMRVPAQLLGLLLLWLPGARCAIQMTQSPSSLSASVGDRVTFACRASQDIKSDLGWYQQKPGKAPKLLIYAASTLQSGVPSRFSGSGSGTDFTLTISSLQPEDSATYYCLHDYNYPRTFGQGTKVEIKRTVAAPSV

SEQ ID NO: 795116 - protein, 146 aa, Homo sapiens
  misc_feature: NA.43.75.G09.1.454.light.4.nb-aa
MDMRVLAQLLGLLLLCFPGARCDIQMTQSPSSLSASVGDRVTFTCRASQRISNYLAWFQQKPGKAPQSLIYAAFNLHSGVPSRFSASGSGIAFTLTIASLQPEDFATYYCQQYDDYPYTFGQGTKLEINRTVAAPSVFIFPPSELL

SEQ ID NO: 795117 - protein, 140 aa, Homo sapiens
  misc_feature: NA.43.83.H06.1.454.light.4.nb-aa
METPAQLLFLLLLWLPDTTGETVLTQSPGTLSLSPGERATLSCRASQSVITDSLAWYQQKPGQAPRLLIYGASSRITGIPARFSGHGSGTEFTLTISRLEPEDFAVYYCQQYGSSPLTFGGGTKVEVKRTVAAPSVFIFP

SEQ ID NO: 795118 - protein, 145 aa, Homo sapiens; identical to SEQ ID NO: 795110
  misc_feature: NA.43.9.A09.1.454.light.4.nb-aa

SEQ ID NO: 795119 - protein, 147 aa, Homo sapiens
  misc_feature: NA.48.1.A01.1.454.light.4.nb-aa
MDMRVPAQLLGLLLLWFPGSRCDIQMTQSPSSVSASVGDRVTITCRASQDVSPLLAWYQQKPGKAPKLLIFAVSSLQSGVPSRFSGSGSGAEFILTINSLQPEDFATYYCQQGDSFPPTFGGGTRVDVKRTVAAPSVFIFPPSDMYT

SEQ ID NO: 795120 - protein, 144 aa, Homo sapiens
  misc_feature: NA.48.17.B06.1.454.light.4.nb-aa
MAWALLLLTLLTQDTGSWAQAALTQPASVSASPGQSVNLSCTGTAYDIGKYNLVSWYQQHPGKAPKLIIYTVNKRPSGVSARFSGSKSGDTASLTISGLQADDEASYCCSSYVGSGSYLIFGGGTKLTVLRQPKAAPSVTLFPP

SEQ ID NO: 795121 - protein, 135 aa, Homo sapiens
  misc_feature: NA.48.2.A02.1.454.light.4.nb-aa
MDMRVPAQLLGLLLLWLPGARCVIQMTQSPSSLSVSVGDKVTITCRASQDIRSELGWYQQKPGKAPKLLIYAASTLQNGVPSRFSGSGSGTEFTLTISTLQPEDFATYFCLQDSNYPRTFGQGTKVDVNRTVAAP

SEQ ID NO: 795122 - protein, 148 aa, Homo sapiens
  misc_feature: NA.48.22.B11.1.454.light.4.nb-aa
MDMRVPAQLLGLLLLWLPGARCAIQLTQSPSSLSASVGDRVSITCRASQGIRSYLAWFQQKPGKAPKLLIYAASTLHSGVPSRFSGSGSGTDFTLTISSLQPEDVATYYCQQLSSNPPYTFGQGTKVEIKRTVAAPSVFIFPPSDMYT

SEQ ID NO: 795123 - protein, 141 aa, Homo sapiens
  misc_feature: NA.48.31.C09.1.454.light.4.nb-aa
PSNTLPAQLLGLLLLWLRGARCDIQLTQSPSSLSASVGDRVTITCRASQNIGDYFNWYQQKPGKAPKLLIYTAARLQSGVPSRFSGNGSGTDFRLTISSLQPEDFATYFCHQAYNSPPTFGQGTKVEVRRTVAAPSVFIFP

SEQ ID NO: 795124 - protein, 136 aa, Homo sapiens
  misc_feature: NA.48.5.A05.1.454.light.4.nb-aa
MDMRVPAQLLGLLLLWLPGAKCDIQMTQAPSTLSASVGDRVTITCRASQSIVSWLAWYQQRPGKAPKLLIYTASTLQSGVPSRFSGSASGTEFTLTISSLQPDDFATYYCQQYYTYPWTFGQGTKVEIKRTVAAPS

SEQ ID NO: 795125 - protein, 147 aa, Homo sapiens
  misc_feature: NA.48.66.F11.1.454.light.4.nb-aa
MSVPTMAWMMLLLGLLAYGSGVHSQSVVTQEPSFSVSPGGTVTLTCGLTSGSVAPVHYPSWYQQIPGQAPRTLIFMKQIRSSGVPDRFSGSIVGGKAALTITGAQAEDEANYYCMLHRGRGTWEFGGGTKLTVLGQPKAAPSVTLFP

SEQ ID NO: 795126 - protein, 148 aa, Homo sapiens
  misc_feature: NA.48.7.A07.1.454.light.4.nb-aa
MASFPLLLTLLTHCAGSWAQSVVTQPPSASGTPGQRVTISCSGSSANIGRNTVNWYQQLAGTAPKLLIYDHHKRPSGVPDRFSGSKSGSSASLAISGLQSEDEADYYCAAWDDSLNAWVFGGGTKVTVLGQPKAAPSVTLFPPSSMYT

SEQ ID NO: 795127 - protein, 146 aa, Homo sapiens
  misc_feature: NA.48.71.G05.1.454.light.4.nb-aa
METPAQLLFLLLLWLPDTTGEIVLTQSPGTLSLSPGESATLSCRASQNVKSHSLAWYQQKPGQPPRLLIYGASTRATGIPDRFSGSGSGTDFTLTITRLEPDDFAVFFCQQYGSSPRTFGQGTKVEIKRTVAAPSVFIFPPSDMYT

SEQ ID NO: 795128 - protein, 137 aa, Homo sapiens
  misc_feature: NA.48.72.G06.1.454.light.4.nb-aa
MLPSQLIGFLLLWVPASRGEIVLTQSPDFQSVTPKEKVTITCRASQSIRGSLHWYQQKPDQSPKLLIKYASESISGVPSRFSGSGSGTDFTLTINSLEAEDAATYYCHQTFSLRRTFGQGTRLEIKRTVAAPSVFIF

SEQ ID NO: 795129 - protein, 146 aa, Homo sapiens
  misc_feature: NA.48.74.G08.1.454.light.4.nb-aa
MAGFPLLLTLLTHCTGSWAQSVLTQPPSASGTPGQRVTISCSGSSSNIGSNSVFWYQQLPGSAPKLLIYMNNQRPFGVPDRFSGSKSDTSASLAISGLRSEDEADYYCAAWDDSHVLFGGGTKVTVLGQPKAAPSVTLFPPSSMYT

SEQ ID NO: 795130 - protein, 141 aa, Homo sapiens
  misc_feature: NA.48.8.A08.1.454.light.4.nb-aa
MEAPAQLLFLLLLWLPGFTGEIVLTQSPVTLSLSPGQRATLSCRANESIGNFLGWYQQKPGQAPRLLIYDASHRARGIPARFSGSGSGTDFTLTISTLEREDFAVYYCQHRKTWPLSGFGQGTKLDIKRTVAAPSVFIFPP

SEQ ID NO: 795131 - protein, 145 aa, Homo sapiens
  misc_feature: NA.49.10.A10.1.454.light.4.nb-aa
MAWTVLLLGLLSHCTDSVTSYVLTQPPSASVAPGQTATIPCRGDDIGGKAVHWYQQKPGQAPELVLHGDSDRPSGIPERFSGSNSGEMATLTITRAEAGDEADYYCQVWDSDTDHWVFGGGTKVTVLGQPKAAPSVTLFPPSSLS

SEQ ID NO: 795132 - protein, 144 aa, Homo sapiens
  misc_feature: NA.49.11.A11.1.454.light.4.nb-aa
MAWTVLLLGLLSHCTDSVTSYVLTQPPSVSVAPGQTARITCGGNDIGSKTVHWYQQKPGQAPVLVVYGDGDRPSGIPERFSGSNSGNPATLTISRVEDGDEADYYCQVWDSGSGVVFGAGTRVTVLGQPKANPTVTLFPPSSLS

SEQ ID NO: 795133 - protein, 143 aa, Homo sapiens
  misc_feature: NA.49.16.B05.1.454.light.4.nb-aa
MAWIPLLLPLLTLCTGSEASYELTQPPSVSVSPGQTARITCFGDTLRKEYGHWYQQKTGQAPVLVVYKDSERPSGIPERFSGSSSGTTVTLTISGVQAEDEADYYCQSADTGGTYRVFGGGTKLTVLGQPKAAPSVTLFPPSS

SEQ ID NO: 795134 - protein, 149 aa, Homo sapiens
  misc_feature: NA.49.19.B08.1.454.light.4.nb-aa
MTCSPLLLTLLIHCTGSWAQSVLTQPPSVSAAPGQKVTISCSGSNSNIGKNYVSWYQQFPGRAPRLLIHDNSKRVPEIPDRFSGSKSGTSATLAITGLQTGDEADYYCGTWDSSLSGVRVFGGGTKLTVLGQPKAGPSVTLFPPSSLST

SEQ ID NO: 795135 - protein, 137 aa, Homo sapiens
  misc_feature: NA.49.20.B09.1.454.light.4.nb-aa
MAWIPLLLPLLTLCTGSEASYELTQSPSVSVSSGQTARITCSGDALPKQYAYWYQQRPGQAPVLVIYKDFERPSGTPERFSGSSSGTTVTLTISGVRPEDEADYYCQSADSSGSYVVFGGGTTLTVLGQPKAAPSVT

SEQ ID NO: 795136 - protein, 147 aa, Homo sapiens
  misc_feature: NA.49.21.B10.1.454.light.4.nb-aa
MAWALLFLTLLTQGTGSWAQSALTQPASVSGSPGQSITISCTGTGNDIGGYNFVSWYQHHPDKAPRLIIYGVGDRPSGVSNRFSGSKSGYTASLTLSGLQAEDEADYYCASYTNNNIWVFGGGTKLTVLGQPKAAPSVTLFPPSSLS

SEQ ID NO: 795137 - protein, 136 aa, Homo sapiens
  misc_feature: NA.49.3.A03.1.454.light.4.nb-aa
MEAPAQLLFLLLLWLPDTTGEIVMTQSPATLSVSPGERATLSCRTSQSVNNKLAWYQQRPGQAPRLLIYDVSTRATGIPARFSGSGSGAEFTLTISSLQSEDFAVYYCQHSNDWPLYTFGPGTKVEIKRTVAAPSV

SEQ ID NO: 795138 - protein, 138 aa, Homo sapiens
  misc_feature: NA.49.31.C09.1.454.light.4.nb-aa
MAWALLLLTLLTQGTGSWAQSALTQPPSASGSPGQSLTISCTGGYNSVSWYQQHPGKAPKLMIYEVNRRPSGVPDRFSGSKSGTTASLTVSGLQAEDEADYYCSSSAGINNFNVVFGGGTKLTVLGQPKAAPSVTLFP

SEQ ID NO: 795139 - protein, 142 aa, Homo sapiens
  misc_feature: NA.49.43.D10.1.454.light.4.nb-aa
MASFPLLLTLLTHCAGSWAQSVLTQPPSASGTPGQRVTISCSGGSSNIGSNDVNWYQQIPGTAPNVFIFGNDQRPSGVPDRFSGSKSGTSASLAISGLQSEDEADYYCATWDDSLNAVVFGGGTKVTVLGQPKAAPSVTLFP

SEQ ID NO: 795140 - protein, 134 aa, Homo sapiens
  misc_feature: NA.49.46.E02.1.454.light.4.nb-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPS

SEQ ID NO: 795141 - protein, 137 aa, Homo sapiens
  misc_feature: NA.49.48.E04.1.454.light.4.nb-aa
MAWTPLLLPLLTFCTVSEASYELTQPPSVSVSPGQTARITCSGDALPKKYAYWYQQKSGQAPVLVIYEDSKRPSGIPARFSASSSGTMATLTISGAQVEDEADYYCYSTDSSAEGVFGGGTKLTVLGQPKAAPSVTL

SEQ ID NO: 795142 - protein, 141 aa, Homo sapiens
  misc_feature: NA.49.63.F08.1.454.light.4.nb-aa
MDMRVPAQLLGLLLLWLRGARCDIQMTQSPSSLSASVGDRVTITCRASQSISGYLNWYLHSPGKAPKVLIYAASSLQSGVPSRFIGSGFGTDFTLTITSLRPEDFGTYYCQHSYSIPYSFGQGTKLEITRTVAAPSVFIFP

SEQ ID NO: 795143 - protein, 138 aa, Homo sapiens
  misc_feature: NA.49.64.F09.1.454.light.4.nb-aa
MDMRVPAQLLGLLLLWLRGARCDIQMTQSPSALSASVGDRVTIICRASQSISNYLNWYQHTPGKAPKLLIYAAANLQSGVPSRFSGSGSGTEFTLTISSLQPEDFGKYYCQQSYGNLLIFGGGTKVEIKRTVAAPSVF

SEQ ID NO: 795144 - protein, 141 aa, Homo sapiens
  misc_feature: NA.49.65.F10.1.454.light.4.nb-aa
MAWTVLLLGLLSHCTVSVTSYVLSQSPSVSVAPGQTARITCGGDNIGNKGVHWYQQMPGQAPVLVVFDDSDRPSGIPERFSGSNSGDTATLTISRVEAGDEADYYCHVWDSSSDHVVFGGGTKLTVLGQPKAAPSVTLFPP

SEQ ID NO: 795145 - protein, 137 aa, Homo sapiens
  misc_feature: NA.49.67.G01.1.454.light.4.nb-aa
MEAPAQLLFLLLLWLPDTTGESVLSQSPATLSLSPGERATLSCRATQSVSTYLAWYQQRPGQPPRLLIYDTSNRATGIPARFSGSGSGTDFTLTISSLEPEDFAVYYCQQRYNWPPMYTFGQGTKLEIRRTVAAPSV

SEQ ID NO: 795146 - protein, 139 aa, Homo sapiens
  misc_feature: NA.49.70.G04.1.454.light.4.nb-aa
MDMRVPAQLLGLLLLWLRGARCDIQMTQSPSSLSASVGDRVTIICRASQSISNYLNWYQHTPGKAPRLLIYAAANLQSGVPSRFSGSGSGTEFTLTISSLQPEDFGKYYCQQSYGNLLIFGGGTKVEIKRTVAAPSVFI

SEQ ID NO: 795147 - protein, 145 aa, Homo sapiens
  misc_feature: NA.49.71.G05.1.454.light.4.nb-aa
MAWTVLLLGLLSHCTGSVTSYVLTQTPSVSVAPGQTALIPCMGDDIGSKSVHWYQQKPGQAPLLVVYDDRDRPAGVPERFSGASSQNTATLIINRVEVGDEADYYCQVWDTEIEYVFGTGTKVTVLGQPKANPTVTLFPPSSLST

SEQ ID NO: 795148 - protein, 136 aa, Homo sapiens
  misc_feature: NA.49.8.A08.1.454.light.4.nb-aa
MDMRVPAQLLGLLLLWLSGARCIIQMTQSPSSLSASIGDRITITCRASQDISMYLNWYQQKPGTAPKLLILDASTLETGVPSRFSGSGSGTDFTFTISRLQPEDIATYYCQQYDSLPLTFGGGTKVEIKRTVAAPS

SEQ ID NO: 795149 - protein, 137 aa, Homo sapiens
  misc_feature: NA.49.86.H09.1.454.light.4.nb-aa
MEAPAQLLFLLLLWLPETTGEIAMTQSPATLSVSPGERATLSCRASQSVSSNLAWYQQKPGQAPRLLIYGASTRATGIPARFSGSGSGTEFTLTISSLQSEDFAVYYCQQRYNWPPMYTFGQGTKLEIRRTVAAPSV

SEQ ID NO: 795150 - protein, 139 aa, Homo sapiens
  misc_feature: NA.51.10.A10.1.454.light.4.nb-aa
MASFPLLLTLLTHCAGSWAQSVLTQPPSASGTPGQRVTISCSGSNSNIGSYTADWYQQLPGSAPKLLIYTTNQRATGVPDRFSGSKSGTSASLAISGLQSEDEAQYFCASWDDSLNGPVFGGGTKLTVLSQPKAAPSVT

SEQ ID NO: 795151 - protein, 139 aa, Homo sapiens
  misc_feature: NA.51.11.A11.1.454.light.4.nb-aa
MDMRVPAQLLGLLLLWLSGARCDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKRTVAAPSVFI

SEQ ID NO: 795152 - protein, 141 aa, Homo sapiens
  misc_feature: NA.51.14.B03.1.454.light.4.nb-aa
MDMRVPAQLLGLLLLWFPGSRCDIQMTQSPSSVSASVGDRVTMTCRASQGIDDYLAWLQQKPGKAPKLLIYAASRLESGVPSRFSGSGSGTDFTLTISSLQPEDFATYYCQQAKSYPLTFGGGTKVETKRTVAAPSVFIFP

SEQ ID NO: 795153 - protein, 147 aa, Homo sapiens
  misc_feature: NA.51.15.B04.1.454.light.4.nb-aa
MRLPAQLLGLLMLWVSGSSGDIVMTQSPLSLPVTPGEPASISCRSSQSLLHSNGFSYLDWYLQRPGQSPQLLIYLGSNRAPGVPDRFSGSGSGTDFTLKISSVEAEDVGVYYCMQALQTPTFGQGTKVEIKRTVAAPSVFIFPPSDR

SEQ ID NO: 795154 - protein, 142 aa, Homo sapiens
  misc_feature: NA.51.25.C03.1.454.light.4.nb-aa
MDMRVPAQLLGLLLLWLRGARCDIQMTQSPSSLSASIGDRVTIPCRSSQNISNYLNWYQQKPGKAPNLLIYAASTLQSGVPSRFSGSGSGTDFSLTITNLRPEDFATYYCQQAYITPLTFGGGTKVEIKRTVAAPSVFIFPP

SEQ ID NO: 795155 - protein, 136 aa, Homo sapiens
  misc_feature: NA.51.26.C04.1.454.light.4.nb-aa
MAWIPLFLGVLAYCTGSLAAYDLTQPPSVSVSPGQTATITCSGDNLGSKYVSWYQHHPGRSPILLLYHDAKRPSGIPERFSGSNSGDTATLTIRGTQAVDEADYYCQAWDREAAIFGGGTSLTVLGQPKAAPSVTL

SEQ ID NO: 795156 - protein, 148 aa, Homo sapiens
  misc_feature: NA.51.36.D03.1.454.light.4.nb-aa
MASFPLLLTLLTHCAGSWAQSVLTQPPSASGTPGQRVTISCSGSSSNIGTNTVNWYQQLPGTAPKLLIYSNSQRPSGVPDRFSGSKSGSSASLAISGLQSEDEADYYCAAWDGSLNGYVFGIGTKVTVLGQPKANPTVTLFPPSSRST

SEQ ID NO: 795157 - protein, 137 aa, Homo sapiens
  misc_feature: NA.51.39.D06.1.454.light.4.nb-aa
MAWIPLLLPLLTLCTGSEASYVLTQPPSVSVSPGQTARITCSGDALPTHYSYWYQQKPGQAPVLLIYKDSERPSGIPERFSGSTSGTLVTLTISGVQAEDEADYFCQSSDVSGTYVFGTGTKVTVLGQPKANPLSLF

SEQ ID NO: 795158 - protein, 145 aa, Homo sapiens
  misc_feature: NA.51.43.D10.1.454.light.4.nb-aa
MAWTVLLLGLLSHCTVSVTSYVLTQPPSVSVAPGQTARISCGGDNIGSKSVHWYQQRPGQAPVLVVYDYNDRPSGIPDRFSGSISGNTATLTISRVEAGDEADYYCQVWESSSDHYVFGSGTKVTVLGQPKANPTVTLFPPSSRT

SEQ ID NO: 795159 - protein, 137 aa, Homo sapiens
  misc_feature: NA.51.6.A06.1.454.light.4.nb-aa
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYFCQSSDISGTYVFGTGTKVTVLGQPKANPTVTL

SEQ ID NO: 795160 - protein, 136 aa, Homo sapiens
  misc_feature: NA.51.61.F06.1.454.light.4.nb-aa
MDMRVPAQLLGLLLLWLPGARCDIQLTQSPSFLSASVGDRVTITCRASQGISISLAWYQQKPGKAPKLLIYAASTLQTGVPSRFSGSGSGTEFTLTISSLQPEDFATYYCQQLNTYPRTFGGGTKVEIKRTVAAPS

SEQ ID NO: 795161 - protein, 135 aa, Homo sapiens
  misc_feature: NA.51.64.F09.1.454.light.4.nb-aa
MEAPAQLLFLLLLWLPDTTGQIVMTQSPGTLSVSPGERATLSCRASQSVSNNLAWYQQKPGQAPRLLIYGSSTRAADIPARFSGSGSGTEFTLTISSLQSEDFAVYYCQQYDKWPPYTFGQGTRLEIKRTVAAPS

SEQ ID NO: 795162 - protein, 147 aa, Homo sapiens
  misc_feature: NA.51.67.G01.1.454.light.4.nb-aa
MDMRVPAQLLGLLLLWLSGARCVIQMTQSPSSLSASIGDRITITCRASRDISMYLNWYQQKPGTAPKLLILDASTLETGVPSRFSGSGSGTDFTFTISRLQPEDIATYYCQQYDSLPLTFGGGPKVEIKRTVAAPSVFIFPPSDRST

SEQ ID NO: 795163 - protein, 150 aa, Homo sapiens
  misc_feature: NA.51.70.G04.1.454.light.4.nb-aa
MAWSPLLLTLLAHCTGSWAQSVLTQPPSVSGAPGQRVTISCTGSSSNIGTGYDVHWYQQLPGTAPKLLIYSNTHRPSGVPDRFSGSKSGTSASLAITGLQAEDEADYYCQSYDISLSGSWVFGGGTRLTVLSQPKAAPSVTLFPPSSRST

SEQ ID NO: 795164 - protein, 136 aa, Homo sapiens
  misc_feature: NA.51.76.G10.1.454.light.4.nb-aa
MEAPAQLLFLLLLWLPDTTGEVVMTQSPATLSVSPGERATLSCRASQSVSSDLAWYQQKPGQAPRLLIYDASTRATDIPARFSGSGSGTEFTLTISSLQSEDFAIYYCQQYNNWPPYTFGQGTKLEIKRTVAAPSV

SEQ ID NO: 795165 - protein, 148 aa, Homo sapiens
  misc_feature: NA.51.78.H01.1.454.light.4.nb-aa
MDMRVPAQLLGLLLLWLRGARCDIQMTQSPSSLSASVGDRVTITCRASQSISSYLNWYQQRPGKAPNLLIYDASNLESGVPSRFSGSGSGTDFTLTISSVRPEDFATYYCQQSYSTPQLTFGGGTKVEIKRTVAAPSVFIFPPSDRST

SEQ ID NO: 795166 - protein, 151 aa, Homo sapiens
  misc_feature: NA.51.79.H02.1.454.light.4.nb-aa
MRLPAQLLGLLMLWVPGCTGDVVVTQSPLSLPVTLGQAASISCRSSHSLLHSDGNTYLTWFQQRPGQSPRRLIYKVSNRDFGVPDRFSGSGSRTHFTLKISRVEAEDLGVYYCMQGTHWPPYTFGQGTKLEIKRTVAAPSVFIFPPSDRST

SEQ ID NO: 795167 - protein, 142 aa, Homo sapiens
  misc_feature: NA.51.80.H03.1.454.light.4.nb-aa
MAWALLLLTLLTQGTGSWAQSALTQPPSASGSPGQSVTISCTGTSSDVGGYNYVSWYQQHPGKAPKLMIYEVSKRPSGVPDRFSGSKSGNTASLTVSGLQAEDEADYYCCSHAGSIGVLFGGGTKLTVLGQPKAAPSVTLFP

SEQ ID NO: 795168 - protein, 146 aa, Homo sapiens
  misc_feature: NA.51.83.H06.1.454.light.4.nb-aa
MEAPAQLLFLLLLWLPDATGQIVLTQSPVTLSLSPGERATLSCRASQSINSDLAWYQQKPGQAPRLLIYGASTRATGIPARFSGSGSGTDFALTISSLEPEDFAVYYCQQRNNWPPWTFGQGTKVEIKRTVAAPSVFIFPPSDRST

SEQ ID NO: 795169 - protein, 141 aa, Homo sapiens
  misc_feature: NA.52.1.A01.1.454.light.4.nb-aa
MDMRVPAQLLGLLLLWLRGARCVIQMTQSPSSLSASVGDRVIITCRASQSIRTYLNWYQQKPGKAPELLIYGSSTLLSGVPSRFSGSGSGTEFTLTITSLQAEDFATYFCQQSYSSLTFGPGTIVDIKRTVAAPSVFIFPP

SEQ ID NO: 795170 - protein, 133 aa, Homo sapiens
  misc_feature: NA.52.14.B03.1.454.light.4.nb-aa
MAWIPLLLPLLTLCTGSVASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKAA

SEQ ID NO: 795171 - protein, 148 aa, Homo sapiens
  misc_feature: NA.52.15.B04.1.454.light.4.nb-aa
MAWALLFLTLLTQGTGSWAQSALTQPASVSGSPGQSITISCTGTSNDVGTYNSVSWYQQYPGKVPKLMIFEVSDRPAGVSHRFSGSKSGSTASLTISGLQAEDEADYYCSSYTNRNTWVFGGGTKLTVLRQPKAAPRSLCSPTLLYTI

SEQ ID NO: 795172 - protein, 135 aa, Homo sapiens
  misc_feature: NA.52.19.B08.1.454.light.4.nb-aa
MDMRVPAQLLGLLLLWLSGVRCVIQMTQSPSSLSASIGDRITITCRASRDISMYLNWYQQKVGTAPKLLILDASTLETGVPSRFSGSGSGTDFTFTISRLQPEDVATYYCQQYNRLPLTFGGGPKVEIKRTVAAP

SEQ ID NO: 795173 - protein, 142 aa, Homo sapiens
  misc_feature: NA.52.20.B09.1.454.light.4.nb-aa
MAWALLFLTLLTQGTGSWAQSALTQPASVSGSPGQSITIPCTGTSGDIGGYNYVSWYQHHPGKAPKLMIYDISDRPSGVSNRFSGSKSGNTASLTISGLQAEDEADYYCSSYTNNNNWVFGGGTKLTVLGQPKAAPSVTLFP

SEQ ID NO: 795174 - protein, 139 aa, Homo sapiens
  misc_feature: NA.52.22.B11.1.454.light.4.nb-aa
MDMRVPAQLLGLLLLWLRGARCDIQMTQSPSSLSASVGDRVTIICRASQSISSYLNWYQHTPGKAPKLLIYAAANLQSGVPSRFSGSGSGTEFTLTISSLQPEDFGKYYCQQSYGNLLIFGGGTKVEIKRTVAAPSVFI

SEQ ID NO: 795175 - protein, 145 aa, Homo sapiens
  misc_feature: NA.52.23.C01.1.454.light.4.nb-aa
MDMRVPAQLLGLLLLWLSGARCDIQMTQSPSSLSASVGDRVTFTCRASQDISNYLNWYQQKPGKAPKLLIYDASNLETGVPSRFTGSGSGTHFTFTISGLQPEDFATYYCQQYEDLPLTFGGGTKVEIRRTVAAPSVFIFPPSDI

SEQ ID NO: 795176 - protein, 146 aa, Homo sapiens
  misc_feature: NA.52.30.C08.1.454.light.4.nb-aa
MAWALLFLTLLTQGTGSWAQSALTQPASVSGSPGQSITISCTGTGNDIGGYNYVSWYQHHPGKAPKLIIYGVGDRPSGVSNHFSGSKSGNTASLTISGLQAEDEADYYCASYTNNNNWVFGGGTKLTVLGQPKAAPSVTLFPPSSI

SEQ ID NO: 795177 - protein, 138 aa, Homo sapiens
  misc_feature: NA.52.36.D03.1.454.light.4.nb-aa
MAWATLLLPLLNLYAGSVASYELTQLPSVSVSPGQTARITCSGDVLGKNYADWYQQKPGQAPELVIYENSERYPGIPDRFSGSTSGKTTTLTINRVRTEDEADYYCLSGDEDTLVFGGGTKLTVLRQPKAAPSVTLFP

SEQ ID NO: 795178 - protein, 134 aa, Homo sapiens
  misc_feature: NA.52.5.A05.1.454.light.4.nb-aa
MAWIPLFLGVLAYCTGSVASYDLTQPPSVSVSPGQTATITCSGHRLGDIHVSWYQQKPGQSPVLLIYKDVKRPSGIPERFSGSNSGNAATLTISGTQPMDEADYYCQAWDSRFVLFGGGTKLTVLRQPKAAPSV

SEQ ID NO: 795179 - protein, 144 aa, Homo sapiens
  misc_feature: NA.52.51.E07.1.454.light.4.nb-aa
MVLQTQVFISLLLWISGVYGDFVLTQSPDSLAVSLGARATINCKSSRSVFWRPTDKNYLAWYQHKPGHPPKLLISWASTRESGVPDRFSGSGSETDFTLTISSLQAEDVAVYYCQQYAGTPYTFGQGTKVEIKRTVAAPSVFIF

SEQ ID NO: 795180 - protein, 135 aa, Homo sapiens
  misc_feature: NA.52.58.F03.1.454.light.4.nb-aa
MDMRVPAQLLGLLLLWLRGARCDTQMTQSPSSLSASVGDRVTITCRASQSIGKYLNWYQQKPGKAPRLLIYAASNLQSGVPSRFSGRGSGTDFTLTISGLQPEDFGTYYCQQSDNTPQTFGPGTTVDVKRTVAAP

SEQ ID NO: 795181 - protein, 139 aa, Homo sapiens
  misc_feature: NA.52.6.A06.1.454.light.4.nb-aa
MAWALLFLTLLTQGTGSWAQSALTQPASVSGSPGQSITISCTGTSNDIGTYNSVSWYQQYPGKVPKLMIFEVSDRPAGVSHRFSGSKSGSTASLTISGLQAEDEADYYCSSYTSRNTWVFGGGTKLTVLRQPKAAPSVT

SEQ ID NO: 795182 - protein, 144 aa, Homo sapiens
  misc_feature: NA.52.61.F06.1.454.light.4.nb-aa
MAWALLFLTLLTQGTGSWAQSALTQPASVSGSPGQSITISCTGTGNDIGGYNYVSWYQHHPGKAPKLMIYGVGDRPSGVSNRFSGSKSGNTASLTISGLQAEDEADYYCASYTNNNNWVFGGGTKLTVLGQPKAAPSVTLFPPS

SEQ ID NO: 795183 - protein, 142 aa, Homo sapiens
  misc_feature: NA.52.76.G10.1.454.light.4.nb-aa
MAWALLFLTLLTQGTGSWAQSALTQPASVSGSPGQSITISCTGTSNDVGTYNSVSWYQQYPGKVPKLMIFEVSDRPAGVSHRFSGSKSGSTASLTISGLQAEDEADYYCSSYTNRNTWVFGGGTKLTVLRQPKAAPSVTLFP

SEQ ID NO: 795184 - protein, 139 aa, Homo sapiens
  misc_feature: NA.52.78.H01.1.454.light.4.nb-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKAAPSVTLF

SEQ ID NO: 795185 - protein, 147 aa, Homo sapiens
  misc_feature: NA.52.83.H06.1.454.light.4.nb-aa
MDMRVPAQLLGLLLLWLSGARCDIQMTQSPSSLSASVGDRVTFTCRASQDISNYLNWYQQKPGKAPKLLIYDASNLETGVPSRFSGSGSGTHFTFTISGLQPEDIATYYCQQYGNLPLTFGGGTKVEIKRTVAAPSVFIFPPSDIRS

SEQ ID NO: 795186 - protein, 134 aa, Homo sapiens
  misc_feature: NA.52.85.H08.1.454.light.4.nb-aa
MAWIPLFLGVLAYCTGSVASYDLTQPPSVSVSPGQTATITCSGDKLGGKYACWYQQRPGQSPVLVIYLNSRRPSGIPDRFSGSHSGNTATLTISGTQALDEADYYCQAWDTITGVIFGGGTRLTVLGQPKAAPS

SEQ ID NO: 795187 - protein, 146 aa, Homo sapiens
  misc_feature: NA.53.20.B09.1.454.light.4.nb-aa
MAWTVLLLGLLSHCTGSVTSYVLTQPPSVSVAPGRTATITCGGNNIGSKSVHWYQHKPGQAPALVVYDDSDRPSGIPERFSGSNSGDTATLTISRVEAGDEADYYCQVWDFNSDHWVFGGGTKLTVLGQPKAAPSVTLFPPSSRTA

SEQ ID NO: 795188 - protein, 134 aa, Homo sapiens
  misc_feature: NA.53.31.C09.1.454.light.4.nb-aa
MAWIPLLLPLLTLCTGSEASYELTQSPSVSVSSGQTARITCSGDALPKQYAYWYQQRPGQAPVLVIYKDFERPSGTPERFSGSSSGTTVTLTISGVRPEDEADYYCQSADSSGSYVVFGGGTTLTVLGQPKAAP

SEQ ID NO: 795189 - protein, 140 aa, Homo sapiens
  misc_feature: NA.53.33.C11.1.454.light.4.nb-aa
MAWTPLLLPLLTFCTVSEASYELTQPPSVSVSPGQTARITCSGDALPRKYAYWYQQRSGQAPVLVIYEDTKRPSGIPARFSGASSGTVATLTVSGAQVEDEADYYCYSTDRSGNHRVFGGGTKLTVLGQPKAAPSVTLVP

SEQ ID NO: 795190 - protein, 133 aa, Homo sapiens
  misc_feature: NA.53.34.D01.1.454.light.4.nb-aa
MAWIPLFLGVLAYCTGSVASYELTQPPSVSVSPGQTASITCSGDKLEDKYTCWYQQKPGQSPVLVIYQDRKRPSGIPERFSGSNSGNTATLTISGTQAMDEADYYCQAWDSNPDWVFGGGTKLTVLGQPKAAP

SEQ ID NO: 795191 - protein, 138 aa, Homo sapiens
  misc_feature: NA.53.35.D02.1.454.light.4.nb-aa
MAWTPLLLPLLTFCTVSEASYELTQPPSVSVSPGQTARITCSGDALPRKYAYWYQQRSGQAPVLVIYEDTKRPSGIPARFSGASSGTVATLTVSGAQVEDEADYYCYSTDRSGNHRVFGGGTKLTVLGQPKAAPSVTL

SEQ ID NO: 795192 - protein, 138 aa, Homo sapiens
  misc_feature: NA.53.4.A04.1.454.light.4.nb-aa
MAWSPLLLTLLAHCTGSWAQSVLTQPPSVSGAPGQRVIISCTGTSSNIGSGYDVHWYQQLPGTAPKLLVYGDGSRPSGVPGRFSGSKSGTSASLAITGLQAEDEGHYYCQSYDNRMDPSWVFGGGTKLTVLRQPKAAP

SEQ ID NO: 795193 - protein, 137 aa, Homo sapiens
  misc_feature: NA.53.49.E05.1.454.light.4.nb-aa
MAWTVLLLGLLSHCTDSVTSYVLTQAPSLSVAPGQTARIACGGNNVGSNSVHWYQQKPRQAPVLVFFDHGDRPSGIPERFSGSKSGNTATLTIIRVEAGDEADYYCQLWDSSIHQGAFGGGTKLTVLGQPKAAPSVT

SEQ ID NO: 795194 - protein, 139 aa, Homo sapiens
  misc_feature: NA.53.5.A05.1.454.light.4.nb-aa
MAWIPLLLPLLTLCTGSEASYELTQPPSVSVSPGQTARITCSGDGLPKHYGYWYQQKPGQAPLLVMYKDNERPSGIPERFSGSNSGTTVTLTIGGVQAEDEADYYCQSAGSSGTVLFGGGTKLTVLRQPKAAPSVTLFP

SEQ ID NO: 795195 - protein, 137 aa, Homo sapiens
  misc_feature: NA.53.62.F07.1.454.light.4.nb-aa
MAWTPLLLPLLTFCTVSEASYELTQPPSVSVSPGQTARITCSGDALPRKYAYWYQQRSGQAPVLVIYEDTKRPSGIPARFSGASSGTVATLTVSGAQVEDEADYYCYSTDRSGNHRVFGGGTKLTVLGQPKAAPSVT

SEQ ID NO: 795196 - protein, 140 aa, Homo sapiens
  misc_feature: NA.53.71.G05.1.454.light.4.nb-aa
MAWTVLLLGLLSHCTGSVTSYLLTQPPSVSVAPGRTATMTCAGNNIGSKSVHWYQHRPGQAPALVVYDDSDRPSGIPERFSGSNSGDTATLTISRVEAGDEADYYCQVWDFNSDHWVFGGGTKLTVLGQPKAAPSVTLFP

SEQ ID NO: 795197 - protein, 145 aa, Homo sapiens
  misc_feature: NA.53.77.G11.1.454.light.4.nb-aa
MAWTVLLLGLLSHCTGSVTSFVLTQSPSVSVAPGQTARITCGGNNIGRKSVHWYQQMPGQAPVLVVYDDSDRPSGVPERFSGSNSGNTATLTISRVEAGDEADYYCQVWDTSSDHPWVFGGGTRLTVLGQPKAAPSVTLFPPSSR

SEQ ID NO: 795198 - protein, 141 aa, Homo sapiens
  misc_feature: NA.53.79.H02.1.454.light.4.nb-aa
MAWALLLLTLLTQDTGSWAQSALTQPASVSGSPGQSITISCTGTSSDVGNYNLVSWYQQYPGKAPKVIIFEVNKRPSGVSDRFSGSKSGNTASLTISGLQADDEADYYCCSYAGNRRFAVFGGGTQLTVLGQPKAAPSVTL

SEQ ID NO: 795199 - protein, 140 aa, Homo sapiens
  misc_feature: NA.53.8.A08.1.454.light.4.nb-aa
MAWIPLLLPLLTLCTGSEASHELIQPSSVSVSPGQTATIICSGDALAKQFASWFQQKPGQAPVLVIYKGSERPPGIPERFSGSDSGTTAMLTISGVQAEDEADYYCQSADNTVVSVFFGGGTRLTVLGQPKAAPSVTLFP

SEQ ID NO: 795200 - protein, 134 aa, Homo sapiens
  misc_feature: NA.53.81.H04.1.454.light.4.nb-aa
MAGFPLLLTLLTHCAGSWAQSVLTQPPSASGTPGQRVTISCSGSRSNIGSDFVFWYQLLPGAGPKLLIYRNDQRPSGVPDRFSGSKSGTSASLAISGLRSDDEADYYCAAWDDSLSGVVFGGGTKLTVLGQPKA

SEQ ID NO: 795201 - protein, 138 aa, Homo sapiens
  misc_feature: NA.52.3.A03.1.454.light.4.zerom50-aa
MDMRVPAQLLGLLLLWLPGAKCDIQMTQSPSTLSASVGDRVTISCRASQSISTSLAWYQKKPGKAPKLLISKASDLQTGVPSRFSGSGSGTDFTLTISSLQPDDFASYYCQQYNSFSFTFGPGTTVDIKRTVAAPSVF

SEQ ID NO: 795202 - protein, 142 aa, Homo sapiens
  misc_feature: NA.41.20.B09.1.454.light.4.zerom50-aa
MDMRVPAQLLGLLLLWLPGAKCEIQMTQSPSTLSASVGDTVTITCRASQYINDWLAWYQQKRGRAPKLLIYKAGYLENGAPSRFSGFGTGTEFTLTITGLQPDDFATYYCQQYDVYPLTFGGGTKVEIKGTVAAPSVFIFPP

SEQ ID NO: 795203 - protein, 135 aa, Homo sapiens
  misc_feature: NA.12.8.A08.2.454.light.4.zerom50-aa
MDMRVPAQLLGLLLLWLPGAACDILMTQSPSTLSAAVGDRVTITCRASQNLGRWLAWYQQKPGTAPKLLIFKTSDLESGVPSRFSGSGSGTEFTLTISSLQPDDFATYYCQQYNGYESTFGQGTKLEIKRTVAAP

SEQ ID NO: 795204 - protein, 138 aa, Homo sapiens
  misc_feature: NA.22.25.C03.1.454.light.4.zerom50-aa
MDMRVPAQLLGLLLLWLPGAKCDIQMTQSPSTLSASVGDRVTITCRASQSISVWVAWYQQKPGKAPKVLIYEASTLKTGVPSRFSGSGSGTEFTLAISSLQPDDSATYYCQQYYSYRGTFGQGTKVEIKRTVAAPSVS

SEQ ID NO: 795205 - protein, 138 aa, Homo sapiens
  misc_feature: NA.11.74.G08.1.454.light.4.zerom50-aa
MAWALLLLSLLTQGTGSWAQSALTQPPSASGSPGQSVTISCTGTSSDIGGYNYVSWYQQHPDKAPKLMIYEVTKRPSGVPDRFSGSKSGNTASLTVSGLQADDEADYYCSSYAGSTNLVFGGGTKLTVLGQPKAAPSV

SEQ ID NO: 795206 - protein, 133 aa, Homo sapiens
  misc_feature: NA.10.48.E04.1.454.light.4.zerom50-aa
MEAPAQLLFLLLLWLPDTTGEIVLTQSPATLSLSPGEGATLSCRASQSVSIYLAWFQQKPGQAPRLLIYNASNRATGIPARFSGSGSGTDFTLTISSLEPEDFAVYYCQQRFAWPHTFGQGTKLEIMRTVAAP

SEQ ID NO: 795207 - protein, 151 aa, Homo sapiens
  misc_feature: NA.18.22.B11.1.454.light.4.zerom50-aa
MVLQTQVFISLLLWISGTYGDFVMTQSPDSLAVSLGERATINCKSSQSILKNSNNQNYLTWYQQKAGQPPKLLIYWASTRESGVPDRFSGSGSGTDFTLTISSLQAEDVAVYYCQQYYSTPPTFGQGTKVEIKRTVAAPSVFIFPPSDILV

SEQ ID NO: 795208 - protein, 134 aa, Homo sapiens
  misc_feature: NA.52.69.G03.2.454.light.4.zerom50-aa
MASFPLLLTLLTHCAGSWAQSVLTQPPSASGTPGQRVTISCSGGGSNIGGNTVNWYQQLPGTAPRLLIFSHNQRPSGVPDRFSGSKSGTSASLAISGLQSDDEADYFCATWDDSLNGPVFGGGTKLTVLGQPKA

SEQ ID NO: 795209 - protein, 146 aa, Homo sapiens
  misc_feature: NA.52.62.F07.1.454.light.4.zerom50-aa
MAWTVLLLGLLSHCTGSVASSVVTQPPSVSVAPGKTASITCERDNIERRHVHWYQLRPGQAPRLVLYNDDDRPSGIPERFSGSNSGNTATLTITRVEAGDEADYYCQVWDSNTDQYVFGTGTTVTVLSQPKANPTVTLFPPSSIRS

SEQ ID NO: 795210 - protein, 135 aa, Homo sapiens
  misc_feature: NA.52.62.F07.2.454.light.4.zerom50-aa
  MOD_RES (105)..(105): Any amino acid
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYXCQSSDISGTYVFGTGTKVTVLGQPKAQPTV

SEQ ID NO: 795211 - protein, 138 aa, Homo sapiens
  misc_feature: NA.43.78.H01.4.454.light.4.zerom50-aa
  MOD_RES (116)..(116): Any amino acid
  MOD_RES (122)..(122): Any amino acid
  MOD_RES (135)..(135): Any amino acid
  MOD_RES (137)..(137): Any amino acid
MAWALLLLTLLTQGTGSWAQSALTQPPSASGSPGQSVTISCTGSSSDIGGYTYVSWYQQHPGKAPKLMIYEVNKRPSGVPDRFSGSKSGNTATLTVSGLQAEDEAHYYCCSYAGSXTYVFGXGTTVTVLGQPKAXPXL

SEQ ID NO: 795212 - protein, 139 aa, Homo sapiens
  misc_feature: NA.43.49.E05.1.454.light.4.zerom50-aa
METPAQLLFLLLLWLPDTTGEIVLTQSPGTVSLSPGERATFSCRASQSVSSNYLAWYQQKPGQAPRLLIYGASTRATGIPDRFSGTGSGTDFTLTISRLEPEDFAIYYCQQYAWSPPALTFGGGTKVEIKRTVAAPICS

SEQ ID NO: 795213 - protein, 142 aa, Homo sapiens
  misc_feature: NA.52.46.E02.1.454.light.4.zerom50-aa
MAWALLFLTLLTQGTGSWAQSALTQPASVSGSPGQSITISCTGTSNDVGTYNSVSWYQQYPGKVPKLMIFEVNDRPAGVSHRFSGSKSGSTASLTISGLQAEDEADYYCSSYTNRNTWVFGGGTRLTVLRQPKAAPSVYLFR

SEQ ID NO: 795214 - protein, 148 aa, Homo sapiens
  misc_feature: NA.19.22.B11.1.454.light.4.zerom50-aa
MVLQTQVFISLLLWISGVFGDIVMTQSPDSLAVSLGERATINCKSSQNILYNSNNKNYLAWFQQKPGQPPKMLFYWASARESGVPDRFSGSGSGTDFTLTISGLQAEDVAVYYCQQFYSTPWTFGQGTKVEIKRTVAAPSVFIFPPSD

SEQ ID NO: 795215 - protein, 138 aa, Homo sapiens
  misc_feature: NA.40.70.G04.2.454.light.4.zerom50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPHVVFGGGTKLTVLGQPKAAP

SEQ ID NO: 795216 - protein, 145 aa, Homo sapiens
  misc_feature: NA.48.20.B09.2.454.light.4.zerom50-aa
MAWALLLLTLLTQDTGSWAQAALTQPASVSASPGQSVNLSCTGTAYDIGKYNLVSWYQQHPGKAPKLIIYTVNKRPSGVSARFSGSKSGDTASLTISGLQADDEASYCCSSYVGSGSYLIFGGGTKLTVLRQPKARPLGHSRSPP

SEQ ID NO: 795217 - protein, 141 aa, Homo sapiens
  misc_feature: NA.48.45.E01.2.454.light.4.zerom50-aa
  MOD_RES (18)..(18): Any amino acid
  MOD_RES (33)..(33): Any amino acid
  MOD_RES (52)..(52): Any amino acid
  MOD_RES (85)..(85): Any amino acid
  MOD_RES (106)..(106): Any amino acid
METPAQLLFLLLLWLPDXTGEIVLTQSPGTLSXSPGERATLSCRASQSVSSXYLAWYQQKPGQAPRLLIYGASSRATGIPDRFSXSGSGTDFTLTISRLEPEDFAXYYCQQYGTSPRYTFGQGTKLEIKRTVAAPSVFIFP

SEQ ID NO: 795218 - protein, 137 aa, Homo sapiens
  misc_feature: NA.48.45.E01.5.454.light.4.zerom50-aa
  MOD_RES (133)..(133): Any amino acid
MAWVPLLLPLLTLCTGSQASYELTQPPSVSVSPGQTARITCSGDGLPTQYAYWYQKKPGQAPVLVIYQDTQRASGTPERFSGSSSGATVALTIREVQAEDEADYYCQSADNGGTYLVFGGGTKLNVLGQPKAXPSVY

SEQ ID NO: 795219 - protein, 136 aa, Homo sapiens
  misc_feature: NA.8.49.E05.1.454.light.4.zerom50-aa
MDMRVPAQLLGLLLLWLRGGRCDIQMTQSPPSLSASVGDRVTITCRASQSIGTYLNWYQQKPGKAPKLLINYASSLQSGVPSRFSGGGSGTDFTLTINSLQIEDYATYYCQQSSRTPLTFGGGTKVDVKRTVAAPT

SEQ ID NO: 795220 - protein, 144 aa, Homo sapiens
  misc_feature: NA.53.80.H03.2.454.light.4.zerom50-aa
  MOD_RES (70)..(70): Any amino acid
MAWTVLLLGLLSHCTGSVTSFVLTQSPSVSVAPGQTARITCGGNNIGRKSVHWYQQMPGQAPVLVVYDDXDRPSGVPERFSGSNSGNTATLTISRVEAGDEADYYCQVWDTSSDHPWVFGGGTRLTVLGQPKAAPSVTLFPPSS

SEQ ID NO: 795221 - protein, 135 aa, Homo sapiens
  misc_feature: NA.21.46.E02.1.454.light.4.zerom50-aa
MAWIPLLLPLLTLCTGSEASYELTQPPSVSVSPGQTARITCSADGLPKKYAYWYQQKPGQAPVLVIYKDTERPSEIPERFSGSSSGTAVTLTISEVQAEDEADYYCQTVDSRGTHWVFGGGTKLTVLGQPKAAPS

SEQ ID NO: 795222 - protein, 142 aa, Homo sapiens
  misc_feature: NA.5.64.F09.1.454.light.4.zerom50-aa
MDMRVPAQLLGLLLLWLPGAKCDIQMTQSPATLSAFVGDRITITCRASQTISTWLAWYQQKPGKAPRLLIFDASSLETGVPSRFSGRGSGTEFTLTVNGLQPDDFATYYCHQYSSFPFTFGPGTKVDLSRTVAAPSVFIFPP

SEQ ID NO: 795223 - protein, 143 aa, Homo sapiens
  misc_feature: NA.8.1.A01.1.454.light.4.zerom50-aa
MAWTPLLLPLLTFCTVSEASYELTQPPSVSVSPGQTARITCSGDELPKKYAYWYQQKSGQAPVLVIYEDKKRPSGIPDRLSGSSSGTVATLTITGAQVEDEGDYYCYSPEKDGHHWVFGGGTKLTVLSQPKAAPSVTLVPTLP

SEQ ID NO: 795224 - protein, 141 aa, Homo sapiens
  misc_feature: NA.10.5.A05.1.454.light.4.zerom50-aa
MVLQTQVFISLLLWISGAYGDIVVTQSPESLAVSLGERATISCRSSQSVLFNRNNKECLAWYQQKPGQSPKLLIYWASTRESGVPDRFSGSGSGTEFTLTINSLQAEDVAVYFCQQYLSSPWTFGQGTKVELKRTVAAPSS

SEQ ID NO: 795225 - protein, 136 aa, Homo sapiens
  misc_feature: NA.10.49.E05.1.454.light.4.zerom50-aa
MEAPAQLLFLLLLWLPDATGAVVLTQSPATLSLSPGERATLSCRASQSVSNYLAWYQQKPGQAPRLLIYDVSSRATGVPARFSGSGSGTDFTLTISSLEPEDFAVYYCQQRGHWPAFPFGPGTKVDIKRTVAAPSV

SEQ ID NO: 795226 - protein, 137 aa, Homo sapiens
  misc_feature: NA.51.7.A07.1.454.light.4.zerom50-aa
MPWALLLLTLLTHSAVSVVPAGLTQPPSVSKGLRQTATLTCIGNYYNVGDQGTLWLQQYQGHPPKLLSYRDNTRPSGISERFSASTSGYTASLTITGLQPGDEADYYCSAWDSSLRAWVFGGGTRLTVLSQPKARPP

SEQ ID NO: 795227 - protein, 132 aa, Homo sapiens
  misc_feature: NA.53.32.C10.1.454.light.4.zerom50-aa
MAWIPLFLGVLAYCTGSVASYELSQPPSVSVSPGQTVRITCSGDKLGDKFACWYQQKTGQSPVLVIYQDDKRPSGIPERFSGSNSGNTATLTISGTQAMDEADYYCQAWDSSTMVFGGGTKLTVLGQPKAPP

SEQ ID NO: 795228 - protein, 131 aa, Homo sapiens
  misc_feature: NA.41.24.C02.1.454.light.4.zerom50-aa
MAWIPLFLGVLAYCTGSVASFELTQPPSVSVSPGQTASITCSGDKLGNKYASWYQQKPGQSPVLVIYQSSQRPSGIPERFSGSNSGNTATLTISGTQAIDEAEYYCQAWDISTEVVFGGGTKLTVLGQPKA

SEQ ID NO: 795229 - protein, 137 aa, Homo sapiens; identical to SEQ ID NO: 795145
  misc_feature: NA.49.26.C04.3.454.light.4.zerom50-aa

SEQ ID NO: 795230 - protein, 139 aa, Homo sapiens
  misc_feature: NA.40.44.D11.1.454.light.4.zerom50-aa
  MOD_RES (139)..(139): Any amino acid
MEAPAQLLFLLLLWLPDTTGEIVMTQSPATLSVSPGERATLSCRASQSVNSNLAWYQQKPGQAPRLLIYGASTRATGIPARFSGSGSGTEFTLTISSLQSEDFAVYYCQQYNNWPLTFGGGTKVETKRTVAAPSVFIPX

SEQ ID NO: 795231 - protein, 137 aa, Homo sapiens
  misc_feature: NA.4.6.A06.1.454.light.4.zerom50-aa
MASFPLLLTLLTHCAGSWAQSVLTQAPSASGAPGQRVILSCSGGSSNIGGHPVSWYQHLPGTAPKLLIYTDSKRPAGVPDRFSGSRSGTSASLSISGLRSEDEADYYCSGWDYSLHARLFGGGTKLTVLGQPKARPP

SEQ ID NO: 795232 - protein, 140 aa, Homo sapiens
  misc_feature: NA.43.41.D08.1.454.light.4.zerom50-aa
MVLQTQVFISLLLWISGAYGDVVMTQSPDSLAVSLGGRATINCKSSQSILYSSYNKSDLAWYQQKPGQPPKLLIYWASNRQSGVPDRFSGSGSGTHFAFTISSLQAEDVAVYYCQQYYTTPWTFGQGTKVEIRRTVAAPF

SEQ ID NO: 795233 - protein, 146 aa, Homo sapiens
  misc_feature: NA.53.65.F10.1.454.light.4.zerom50-aa
MAWTVLLLGLLSHCTDSVTSYVLTQPTSVSVAPGQTASITCGGNHIGAKNVHWYQQKPGQAPVLVVYNGSGRPSWIPGRFSGSKSGNTATLTISRVEAGDEADYYCQVWDNSNGGNWVFGGGTKLTVLGQPKAAPSVTLFPPSSRT

SEQ ID NO: 795234 - protein, 136 aa, Homo sapiens
  misc_feature: NA.52.10.A10.2.454.light.4.zerom50-aa
MDMRVPAQLLGLLLLWLRGARCVIQMTQSPSSLSASVGDRVIITCRASQSIRTYLNWYQQKPGKAPELLIYGSSTLLSGVPSRFSGSGSGTEFTLTITSLQAEDFATYFCQQSYSSLTFGPGTIVDIKRTVAAPSV

SEQ ID NO: 795235 - protein, 147 aa, Homo sapiens
  misc_feature: NA.19.81.H04.1.454.light.4.zerom50-aa
MAWTPLFLFLLTCCPGSNSQVVVTQEPSLTVAPGGTVTLTCGSNAGRVTSDQYPYWYQQKPGQAPKTLISDTTNRHSLTPARFSGYLLGGKAALTLSGAQPEDEAEYLCSLVHSGFFVFGGGTRLTVLGQPKAAPSVTLFPPSSTRV

SEQ ID NO: 795236 - protein, 137 aa, Homo sapiens
  misc_feature: NA.21.47.E03.1.454.light.4.zerom50-aa
MDMRVPAQLLGLLLLWFPGSRCDIQMTQSPSSVSASVGDRVTITCRASQGISNWLAWYQQKPGKAPKLLIYAASTLQSGVPSRFSGSGSGTDFNLTITSLQPEDFATYYCQQANSFPLTFGGGTNVEVKRTVAAPSV

SEQ ID NO: 795237 - protein, 140 aa, Homo sapiens
  misc_feature: NA.40.26.C04.2.454.light.4.zerom50-aa
  MOD_RES (3)..(3): Any amino acid
  MOD_RES (17)..(17): Any amino acid
  MOD_RES (19)..(19): Any amino acid
  MOD_RES (22)..(22): Any amino acid
  MOD_RES (29)..(29): Any amino acid
MEXPAQLLFLLLLWLPXAXGEXVLTQSPXTLSLSPGQRASLSCGASQHVGTSLAWYQQKPGQAPRLLIYDASSRATGVPARFSGSGSGTAFTLTISSLEPEDFAVYYCQQRADWPLTFGGGTKVDIKRTVAAPSVFIFPP

SEQ ID NO: 795238 - protein, 137 aa, Homo sapiens
  misc_feature: NA.52.26.C04.3.454.light.4.zerom50-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKARPLGH

SEQ ID NO: 795239 - protein, 141 aa, Homo sapiens
  misc_feature: NA.48.44.D11.1.454.light.4.zerom50-aa
MVLQTQVFISLLLWISGAYGDVVMTQSPDSLAVSLGGRATINCKSSQSILYSSYNKSDLAWYQQKPGQPPKLLIYWASNRQSGVPDRFSGSGSGTHFAFTISSLQAEDVAVYYCQQYYTTPWTFGQGTKVEIRRTVAAPYF

SEQ ID NO: 795240 - protein, 141 aa, Homo sapiens
  misc_feature: NA.40.28.C06.1.454.light.4.zerom50-aa
METPAQLLFLLLLWLPDATGEIVLTQSPGTLSLSPGERATLSCRASQSIRNTVQGWYQHKPGQAPRLLIYETSRRASGIPDRFSGSGSGTDFTLTISRLEPEDSAVYYCQHFEGPLITFGGGTKVEIKRTVAAPSVFIFPS

SEQ ID NO: 795241 - protein, 136 aa, Homo sapiens
  misc_feature: NA.40.28.C06.2.454.light.4.zerom50-aa
MAWALLLLSLLTQGTGSWAHSTLTQPRSVSGSPGQSVTISCTGTSSDIGAYNSVSWYQQHPGKGPKLLIYDVTKRPSGVADRFSGSKSGDTASLTISGLQTEDEATYFCCSYAGSFALEVFGGGTELTVLRQPKAS

SEQ ID NO: 795242 - protein, 146 aa, Homo sapiens
  misc_feature: NA.10.3.A03.1.454.light.4.zerom50-aa
MDMRVPAQLLGLLLLWLPGAKCDIQMAQSPSTLSASVGDRVIITCRASQTFNNWLAWYQKKPGKAPKLLIHTASTLASGVPSRFSGSGAGTEFTLSISSLQPDDFATYYCQQYDTYPFSFGPGTKVDSKRTVAAPSVFIFPPSDTT

SEQ ID NO: 795243 - protein, 137 aa, Homo sapiens
  misc_feature: NA.5.49.E05.1.454.light.4.zerom50-aa
METPAQLLFLLLLWLPDTVGEVVLTQSPDTLSLSPGERATLSCRASESLGGSHLAWYQQKPGQAPRLLIYGASNRATDTPRRFSGSGSGTDFTLTILRVEPEDFAVYYCQQYGFSPHNFGGGTKVETKRTVAAPSVF

SEQ ID NO: 795244 - protein, 141 aa, Homo sapiens; identical to SEQ ID NO: 795130
  misc_feature: NA.48.76.G10.2.454.light.4.zerom50-aa

SEQ ID NO: 795245 - protein, 135 aa, Homo sapiens
  misc_feature: NA.5.49.E05.2.454.light.4.zerom50-aa
METPAQLLFLLLLWLPDTVGEIVMTQSPAILSVSPGERATLSCRASQNIGSNLAWYQQKPGQPPRLLIYRSSTRATDVPTRFSGRGSGTDFSLTISSVQSEDLAVYYCQQCGQWPRTFGPGTTVDIRRTVAAPSV

SEQ ID NO: 795246 - protein, 138 aa, Homo sapiens
  misc_feature: NA.3.23.C01.1.454.light.4.zerom50-aa
METPAQLLFLLLLWLPDTPGEILLTQSPGTLSLSPGERATLSCRASPSVSSNHLAWYQQRPGQAPRLLIHGASNRATGIPDRFSGSGSGTDFTLTISRLEPEDFAVYYCLQYGTSLLVNFGGGTKVEIKRTVAAPSVF

SEQ ID NO: 795247 - protein, 137 aa, Homo sapiens
  misc_feature: NA.10.73.G07.1.454.light.4.zerom50-aa
MDMRVPAQLLGLLLLWLRGARCDIQMTQSPSSLSASLGDRVTITCRASQSITNSLNWFQQRPGKAPKLLVYGASTVQTGVPSRFSGSGFGTDFTLTINNLQPDDFATYYCQQSYTTPITFGPGTKVDIKRTVAAPSV

SEQ ID NO: 795248 - protein, 139 aa, Homo sapiens
  misc_feature: NA.49.84.H07.1.454.light.4.zerom50-aa
MAWALLLLTLLTQDTGSWAQSALTQPASVSGSPGQSITISCTETSSDVGNYNLFSWYQQHPGKAPKLIIYEADQRPSGVSDRFSGSTSGSTASLTISGLQAGDEADYYCCSYAGDSGRRVFGGGTKVTVLGQPKAAPSV

SEQ ID NO: 795249 - protein, 137 aa, Homo sapiens
  misc_feature: NA.16.78.H01.1.454.light.4.zerom50-aa
MEAPAQLLFLLLLWLPDTTGEIVMTQSPATLSVSPGERATLSCRASQSISSNLAWYQQKPGQAPRLLIYGASTRATGIPARFSGSGSGTEFTLTISSLQSEDFAVYYCQQYNNWPPRYTFGQGTKLEIKRTVAAPSV

SEQ ID NO: 795250 - protein, 136 aa, Homo sapiens
  misc_feature: NA.53.58.F03.1.454.light.4.zerom50-aa
MAWIPLFLGVLAYCTGSVASFELTQPPSVSVSPGQTASITCSGDKLGDKHTSWYQQKPGQSPLLVMYQDTKRPSGIPERFSGSNSGNTATLTISGTQAMDEADYYCQAWDSSPNWVFGGGTKLTVLGQPKAAPSVL

SEQ ID NO: 795251 - protein, 146 aa, Homo sapiens
  misc_feature: NA.14.19.B08.1.454.light.4.zerom50-aa
MAGFPLLLTLLTHCAGSWAQSVLTQPPSASGTPGQRVTISCSGSSSKIGSRYVYWFQQLPGTAPKLLIYRNNQRPSGVPDRFSGSKAGTSASLAISGLRSEDEADYYCAAWDDSLSGPWVFGGGTKLTVLSQPKAAPSVTLFPPSS

SEQ ID NO: 795252 - protein, 133 aa, Homo sapiens
  misc_feature: NA.51.68.G02.1.454.light.4.zerom50-aa
MAWIPLFLGVLAYCTGFVASYELIQPPSVSVSPGQTASITCSGDKLRDKYAAWYQQKPGQSPVVVIYQDTKRPSGIPERFSGSTSGNTATLTISGTQAVDEADFYCQAWDSDTAVFGGGTKLTVLGQPKARPP

SEQ ID NO: 795253 - protein, 137 aa, Homo sapiens
  misc_feature: NA.40.52.E08.1.454.light.4.zerom50-aa
  MOD_RES (130)..(130): Any amino acid
MAWALLFLTLLTQGTGSWAQSALTQPASVSGSPGQSITISCTGTSSDIGAYNYVSWYQQHPGEAPKLMIYDVNNRPSGVSNRFSGSKSGNTASLTISGLQAEDEAVYFCSSYTSSNTLVFGGGTKLTVLXQPKARPP

SEQ ID NO: 795254 - protein, 141 aa, Homo sapiens
  misc_feature: NA.52.65.F10.1.454.light.4.zerom50-aa
MDMRVPAQLLGLLLLWFPGARCDIQMTQSPSSVSASVGDRVTITCRASQVVSAWLAWYQQKPGKAPKVLVYATSNLQSGVPSRFRGSGSGTNFTLTISSLQPEDFATYYCQQGYSFPYTFGQGTKLDIKRTVAAPSVFIFP

SEQ ID NO: 795255 - protein, 136 aa, Homo sapiens
  misc_feature: NA.52.80.H03.1.454.light.4.zerom50-aa
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYFCQSSDISGTYVFGTGTKVTVLGQPKANPTVT

SEQ ID NO: 795256 - protein, 136 aa, Homo sapiens
  misc_feature: NA.52.24.C02.3.454.light.4.zerom50-aa
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYFCQSSDISGTYVFGTGTKVTVLGQPKANPTVY

SEQ ID NO: 795257 - protein, 137 aa, Homo sapiens
  misc_feature: NA.15.28.C06.1.454.light.4.zerom50-aa
MDMRVPAQLLGLLLLWLPGAKCDIQMTQSPSTLSASVGDRVTITCRASQSITKWLAWFQQKPGKAPKVLISAASTLQSGVPSRFSGSGSGTEFSLTISSLQPDDFATYYCQVHNNHFGGGTKVEIKRTVAAPSVFIP

SEQ ID NO: 795258 - protein, 136 aa, Homo sapiens
  misc_feature: NA.48.43.D10.2.454.light.4.zerom50-aa
MAWALLLLTLLTQDTGSWAQSALTQPASVSGSPGQSITISCTGTSSDVGSYNLVSWYQQHPGKAPKLMIYEDSKRPSGVSNRFSGSKSGNTASLTISGLQAEDEADYYCCSYADSSTHVVFGGGTKLTVLGQPKAP

SEQ ID NO: 795259 - protein, 138 aa, Homo sapiens
  misc_feature: NA.10.39.D06.1.454.light.4.zerom50-aa
MAWTVLLLGLLSHCTDSVTSYALTQPPSVSVAPGQTATLTCGGYTIGSNRVHWYQQRPGQAPVVVVYNDNDRPSGIPERFSGSNSGNTATLIITRVEAGDEADYYCQVWDFTTDHVGVFGGGTKLTVLSQPKAAPSVY

SEQ ID NO: 795260 - protein, 135 aa, Homo sapiens
  misc_feature: NA.12.31.C09.1.454.light.4.zerom50-aa
MDMRVPAQLLGLLLLWLRGARCDIQLTQSPSSLSASVGDKVTITCRANESIATYLNWYQQKAGKVPKLLIYAATSLQGGFPSRFTGRGSGTEFTLTISSLQPEDIATYYCQQSYRAPITFGQGTRPQIGRTVAAP

SEQ ID NO: 795261 - protein, 143 aa, Homo sapiens
  misc_feature: NA.4.28.C06.1.454.light.4.zerom50-aa
MAWIPLFLGVLAYCTGSGASYQLTQPPSLSVSPGRTAVITCSANDLGERYVSWYLQRPGHSPILVMYQTTKRPSGVPERFSGSKSGDTATLTLSGAQAIDEGDYYCQAWDSTTAVFGGGTRVTVLGQPKAAPSVTLVPTLLLP

SEQ ID NO: 795262 - protein, 146 aa, Homo sapiens
  misc_feature: NA.11.31.C09.1.454.light.4.zerom50-aa
MVLQTQVFISLLLWISGANGDIVMTQSPDFLFVSLGERATINCKASQIILYSSDSKNYLSWFQQKPGQPPKLLIYSTSMRASGVPDRFSGSGSGTDFTLTISSLQTEDVGVYYCQQYSLVPFNFGGGTKVEIKRTVAAPSVFIFPP

SEQ ID NO: 795263 - protein, 137 aa, Homo sapiens
  misc_feature: NA.5.26.C04.1.454.light.4.zerom50-aa
MEAPAQLLFLLLLWLPDTTGEIVMTQSPATLSVSPGERATLSCRASQSVSGRLAWYQQKPGQAPRLLIYGASTRATGIPARFSGSGSGTEFTLTISSLQSEDFAVYYCQQYNDWWTFGQGTKVETKRTVAAPSVFYS

SEQ ID NO: 795264 - protein, 137 aa, Homo sapiens; identical to SEQ ID NO: 795145
  misc_feature: NA.49.25.C03.1.454.light.4.zerom50-aa

SEQ ID NO: 795265 - protein, 137 aa, Homo sapiens
  misc_feature: NA.49.25.C03.5.454.light.4.zerom50-aa
  MOD_RES (48)..(48): Any amino acid
  MOD_RES (50)..(50): Any amino acid
  MOD_RES (52)..(52): Any amino acid
  MOD_RES (65)..(65): Any amino acid
  MOD_RES (69)..(70): Any amino acid
  MOD_RES (73)..(73): Any amino acid
  MOD_RES (76)..(77): Any amino acid
  MOD_RES (87)..(87): Any amino acid
  MOD_RES (90)..(90): Any amino acid
  MOD_RES (100)..(100): Any amino acid
  MOD_RES (111)..(111): Any amino acid
  MOD_RES (113)..(115): Any amino acid
  MOD_RES (117)..(117): Any amino acid
  MOD_RES (121)..(121): Any amino acid
  MOD_RES (124)..(124): Any amino acid
  MOD_RES (126)..(126): Any amino acid
MEAPAQLLFLLLLWLPDTTGEIVMTQSPATLSVSPGERVTLSCRASQXVXSXLAWYQQKPGQAPXLLIXXASXRAXXIPARFSGSGXGTXFTLTISSLZXEDFAVYYCQQXNXXXPXTFGXGTXVXIKRTVAAPSVF

SEQ ID NO: 795266 - protein, 139 aa, Homo sapiens
  misc_feature: NA.4.36.D03.1.454.light.4.zerom50-aa
MDLRVPAQLLGLLLLWLPGAKCDIQMTQSPSTLSASVGDRVTITCRASQSVDNWLAWYQQKPGKAPKLLIYDASGLESGVPSRFSGSGSGTEFTLTISSLQPDDFATYYCQQYYSYSLTFGQGTKVEIKRTVAAPSVFY

SEQ ID NO: 795267 - protein, 137 aa, Homo sapiens
  misc_feature: NA.47.36.D03.1.454.light.4.zerom50-aa
MDMRVPAQLLGLLLLWFPGSRCDIQMTQSPSSVSASVGDRVTITCRASQGISNWLAWYQQKPGKAPNLLISTASTLQSGVPSRFSGSGSGTDFTLTISSLQPEDFGTYYCQQGNSFPLTFGGGTKVEMKRTVAAPFS

SEQ ID NO: 795268 - protein, 137 aa, Homo sapiens
  misc_feature: NA.52.43.D10.2.454.light.4.zerom50-aa
MDMRVPAQLLGLLLLWLSGVRCVIQMTQSPSSLSASIGDRITITCRASRDISMYLNWYQQKVGTAPKLLILDASTLETGVPSRFSGSGSGTDFTFTISRLQPEDVATYYCQQYNRLPLTFGGGPKVEIKRTVAAPSS

SEQ ID NO: 795269 - protein, 147 aa, Homo sapiens
  misc_feature: NA.12.5.A05.1.454.light.4.zerom50-aa
MAWALLFLTLLTQGTGSWAHSALTQPASVSGSPGQSITISCTATSSDVNDNNYFSWYQQHPGKAPKLLIYGVGNRPSGVSNRFSGSKSGKTASLTISGLQPEDEADYYCIAQTRSPTWVFGGGTKLTVLGQPKAAPSVTLFPPSSTS

SEQ ID NO: 795270 - protein, 137 aa, Homo sapiens
  misc_feature: NA.4.41.D08.1.454.light.4.zerom50-aa
MDMRVPAQLLGLLLLWFPGSRCDIQLTQSPSFVSASVRDRLTITCRASQDISTNLAWYQQKPGRAPKLLIYGASSLQSGVPSRFRGSGSGTDFTLTISGLQPEDYATYYCQSSNSFPRTFGQGTKVEIKRTVAAPSS

SEQ ID NO: 795271 - protein, 141 aa, Homo sapiens
  misc_feature: NA.41.71.G05.1.454.light.4.zerom50-aa
MDMRVPAQLLGLLLLWLPGAKCDIQMTQSPSTLSASVGDRVTITCRASQVINNWLAWYQQKPGKAPKLLIYKASTLESGVPSRFSGSGSGTEFTLTIGSLQPEDIATYYCQQYNTYSGAFGQGTKVEIKRTVAAPSVFIFP

SEQ ID NO: 795272 - protein, 149 aa, Homo sapiens
  misc_feature: NA.15.5.A05.1.454.light.4.zerom50-aa
MAWTPLFLFLLTCCPGSNSQAVVTQEPSLTVSPGGTVTLTCGSSTGAVTNGHYPYWFQQKPGQAPRTLIYDTNNKHSWTPARFSGSLVGGKAALTLSGAQPEDEAEYYCLLSYSGVRVFGGGTKLTVLGQPKAAPSVTLFPPSSLRRRE

SEQ ID NO: 795273 - protein, 137 aa, Homo sapiens
  misc_feature: NA.51.24.C02.3.454.light.4.zerom50-aa
MAWALLLLTLLTQGTGSWAQSALTQPPSASGSPGQSVTISCTGTSSDVGGYNYVSWYQQHPGKAPKLMIYEVSKRPSGVPDRFSGSKSGNTASLTVSGLQAEDEADYYCCSHAGSIGVLFGGGTKLTVLGQPKARPL

SEQ ID NO: 795274 - protein, 138 aa, Homo sapiens
  misc_feature: NA.52.25.C03.2.454.light.4.zerom50-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKAAPSVTS

SEQ ID NO: 795275 - protein, 141 aa, Homo sapiens
  misc_feature: NA.49.13.B02.1.454.light.4.zerom50-aa
MAWIPLLLPLLTLCTGSEASSELQQTSSVSASPGQTARITCSGDALAKQFASWFQQKPGQAPILMIYKGSERPSGIPERFSGSHSGATAVLTITGVQAEDEADYYCQSADNTIVSVFFGGGTRLTVLGQPKARPLGPLCSP

SEQ ID NO: 795276 - protein, 141 aa, Homo sapiens
  misc_feature: NA.10.88.H11.1.454.light.4.zerom50-aa
MEAPAQLLFLLLLWLPGTTGEIVLTQSPATLSFSPGDRVTLSCRASYGVGAYLNWYQQKRGQAPRLLIYEASTRATGVPARFDGSGSGTDFTLTISSLEPEDIAVYYCQQRSRWPFTFGPGTKVEIKRTVAAPSVFIFPPS

SEQ ID NO: 795277 - protein, 137 aa, Homo sapiens; identical to SEQ ID NO: 795035
  misc_feature: NA.9.78.H01.1.454.light.4.zerom50-aa

SEQ ID NO: 795278 - protein, 133 aa, Homo sapiens
  misc_feature: NA.47.77.G11.2.454.light.4.zerom50-aa
MEAPAQLLFLLLLWLPETTGEIVMTQSPATLSVSPGERATISCRAGQSISINLAWYQQRPGQAPRLLIYDASTRATGFPARFSGSASGTEFTLTINSLQSEDFAVYYCQQYHNWPLTFGQGTRLEIKRTVAAP

SEQ ID NO: 795279 - protein, 141 aa, Homo sapiens
  misc_feature: NA.48.20.B09.1.454.light.4.zerom50-aa
MTCSPLLLTLLIHCTGSWAQSVLTQPPSVSAAPGQKVTISCSGSSSNIGSNYVSWFQQFPGTAPKLLIHDTNKRPSGIPDRFSGSKSGTSATLGITGLQTGDEADYYCGTWEGSLSATQWVFGGGTKLTVLGQPKAAPSVY

SEQ ID NO: 795280 - protein, 138 aa, Homo sapiens
  misc_feature: NA.3.59.F04.2.454.light.4.zerom50-aa
MASFPLLLTLLAHCAGSWAQSVLTQAPSASGAPGQRVTIFCSGSSSNIGRNNVNWYQHLPGSAPKHLIYSNNERPSGVPVRFSGSRSGTSASLAISGLQSDDEADYYCSSWDSNLNNRIFGGGTKLTVLGQPKAAPSV

SEQ ID NO: 795281 - protein, 135 aa, Homo sapiens
  misc_feature: NA.13.36.D03.3.454.light.4.zerom50-aa
MAGFPLLLTLLTHCAGSWAQSVLTQPPSASGTPGQSVTISCSGGSANIGSNYAFWYQQLPGTAPRLLIYSNNQRPSGVPDRFSGSKSGTSASLAISGLRSDDEADYYCSAWDDSLNTWVFGGGTKLTALGQPKAP

SEQ ID NO: 795282 - protein, 139 aa, Homo sapiens
  misc_feature: NA.40.28.C06.3.454.light.4.zerom50-aa
MEAPAQLLFLLLLWLPAATGEVVLTQSPATLSLSPGQRASLSCGASQHVGTSLAWYQQKPGQAPRLLIYDASSRATGVPARFSGSGSGTAFTLTISSLEPEDFAVYYCQQRADWPLTFGGGTKVDIKRTVAAPSVFIFP

SEQ ID NO: 795283 - protein, 142 aa, Homo sapiens
  misc_feature: NA.46.67.G01.1.454.light.4.zerom50-aa
MDMRVPAQLLGLLLLWLRGARCDIELTQSPSSLSATVGDSVTITCRASRNIDTYLNWYQHRPGTAPKLLIYAASSLQSGVPSRFSGSGSGTDFTLTISNLQREDFATYYCQQNYNVFGQGTRLQIKRTVAAPSVFIFPPSVR

SEQ ID NO: 795284 - protein, 135 aa, Homo sapiens
  misc_feature: NA.51.40.D07.1.454.light.4.zerom50-aa
MDMRVPAQLLGLLLLWLSGARCDIQMTQSPSSLSASVGDRVTITCQASEDISNYLNWYQQKPGQAPKLLIYDASNLETGVPSRFSGSGSGTDFTFTISSLHPEDLATYYCQQYDNLPLTFGGGTKVEIKRTVAAP

SEQ ID NO: 795285 - protein, 132 aa, Homo sapiens
  misc_feature: NA.51.52.E08.1.454.light.4.zerom50-aa
MAWIPLLLPLLILCTVSVASYELTQPYSVSVSPGQTARITCSGDVLGKKYARWFQQKAGQAPVLMIYKDTERPSGIPERFSGSSSGTTVTLTISGAQVDDEADYYCYSAADNNSGIFGGGTKLTVLGQPKAP

SEQ ID NO: 795286 - protein, 137 aa, Homo sapiens
  misc_feature: NA.7.31.C09.1.454.light.4.zerom50-aa
MAWALLLLTLLTQGTGSWAQSALTQPPSASGSPGQSVTISCTGTSSDVGGYKYVSWYQQHPGKAPKLMIYEVTKRPSGVPDRFSGSKSGNTASLTVSGLQAEDEADYYCCSYAGRNSDLFGGGTKLTVLGQPKAAPS

SEQ ID NO: 795287 - protein, 139 aa, Homo sapiens
  misc_feature: NA.5.73.G07.1.454.light.4.zerom50-aa
MEAPAQLLFLLLLWLPDTTGEIVMTQSPAALSVSPGERASLSCRASQSVRINLAWYQQKPGQPPRPLIYAASARATGIPARFSGSGSGTDFTLTISSLQSEDFAVYYCQQYDDWPQTFGQGTKVEVKRTVAAPSVFYLP

SEQ ID NO: 795288 - protein, 137 aa, Homo sapiens
  misc_feature: NA.43.22.B11.1.454.light.4.zerom50-aa
MTCSPLLLTLLIHCTGSWAQSVLTQPPSVSAAPGQKVTISCSGSSSNIGNNFVSWYQQLPGTAPKLLIYDSNRRPSGIPDRFSGSKSGTSATLGITGLQTGDEADYYCGTWDSSLNTWVFGGGTRLTVLSQPKAAPS

SEQ ID NO: 795289 - protein, 143 aa, Homo sapiens
  misc_feature: NA.8.2.A02.1.454.light.4.zerom50-aa
MEAPAQLLFLLLLWLPGTTGEIVLTQSPATLSLSPGDRVTLSCRASYGVGGYLAWYQQKRGQAPRLLIYEASTRATGIPARFNGSGSGTDFTLTISSLEPEDIAVYYCQQRSNWPFTFGPGTKVEIKRTVAAPSVFIFPPYST

SEQ ID NO: 795290 - protein, 140 aa, Homo sapiens
  misc_feature: NA.12.18.B07.1.454.light.4.zerom50-aa
MEAPAQLLFLLLLWLPDTTGEIVLTQSPATLSLSPGERATLSCRASQSVNRYLAWYQQRPGQAPRLLIYDTLKRATGISGRFNGSGSGTDFTLTLTSLEPEDFGIYYCQQRSNWPPTFGGGTKVEIKRTVAAPSVFIFPP

SEQ ID NO: 795291 - protein, 137 aa, Homo sapiens
  misc_feature: NA.16.75.G09.1.454.light.4.zerom50-aa
MAWALLLLTLLTQGTGSWAQSALTQPASVSGSPGQSITISCTGTSSDVGRYNYVSWYQQHPGNAPRLMIYEVNDRPSGISNRFSGSKSGNTASLTISDLQPEDEAEYYCSSYTTKSLVVFGGGTKLTVLGQPKAAPS

SEQ ID NO: 795292 - protein, 134 aa, Homo sapiens
  misc_feature: NA.12.27.C05.1.454.light.4.zerom50-aa
MAWIPLFLGVLAYCTGSVASYELTQPPSVSVSPGQTANITCSGDKLGHKYVCWYQQKAGQSPVVIIYQDNKRPSGIPERFSGSNSGNTATLTISGTQAMDEADYYCQARDSSTAVFGGGTKLTVLGQPKAAPSV

SEQ ID NO: 795293 - protein, 136 aa, Homo sapiens
  misc_feature: NA.5.3.A03.1.454.light.4.zerom50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVLGQPKAAP

SEQ ID NO: 795294 - protein, 142 aa, Homo sapiens
  misc_feature: NA.48.11.A11.1.454.light.4.zerom50-aa
MAWTVLLLGLLSHCTGSVTSYVLTQPPSVSVAPGKTARITCGGTNIGRRSVHWYQQKPGQAPLMIVYDDSDRPSGIPERVAGSNSGNTATLAISRVEAGDEADYYCQVWDNGGDHPVFGGGTKLTVLSQPKAAPSVTLFPPS

SEQ ID NO: 795295 - protein, 139 aa, Homo sapiens
  misc_feature: NA.14.59.F04.1.454.light.4.zerom50-aa
MRLPAQLLGLLMLWVSGSSGDIVMTQSPLSLTVTPGEPASISCRSSQSLLHTNGNNFLDWYLQKPGQSPQLLIYLGSNRASGVPDRFSGSGSGTDFTLKISRVEAEDVGVYYCMQALQTRTFGQGTKVEIKRTVAAPSV

SEQ ID NO: 795296 - protein, 144 aa, Homo sapiens
  misc_feature: NA.48.63.F08.1.454.light.4.zerom50-aa
MDMRVPAQLLGLLLLWLPGAECDIQMTQFPSALSASVGDRVTITCRASQSVNKWLAWYQQKPGKAPNLLIYEASTLQSGVPSRFSGSASGTDFSLTISSLHPDDFATYYCQQYYTYPYTFGQGTKLEIKRTVAAPSVFIFPVPP

SEQ ID NO: 795297 - protein, 134 aa, Homo sapiens
  misc_feature: NA.10.52.E08.1.454.light.4.zerom50-aa
METPAQLLFLLLLWLPGTTGEIVLTQSPGTLSLSPGERATLSCRASQSVNNNYLAWYQQKPGQAPRLLIYDASSRATGIPDRFSGSGSGTDFTLTISRLEPEDFAVYYCQQYGAPRLSFGGGTKVEIKRTVAAP

SEQ ID NO: 795298 - protein, 137 aa, Homo sapiens
  misc_feature: NA.52.69.G03.1.454.light.4.zerom50-aa
MDMRVPAQLLGLLLLWLPGARCDIQLTQSPSFLSASVGDRVTITCRTSEDIYTRLAWYQQEPGRAPKLLIHTASTLHAGVPFRFGGSGSGTEFTLTISSLQTEDSAIYYCQQRHRYPITFGQGTRLEIKRTVAAPSV

SEQ ID NO: 795299 - protein, 146 aa, Homo sapiens
  misc_feature: NA.53.19.B08.1.454.light.4.zerom50-aa
MAWTVLLLGLLSHCTGSVTPYVLTQPPSVSVAPGQAATITCGGDYIGRKSVHWYQHQPGQAPMMLLYDDTHRPSGIPERFSGSNSENTATLTISGVEAGDEAVYYCQVWDSSGDLWVFGGGTTLTVLGQPKAAPSVTLVPTLLSYC

SEQ ID NO: 795300 - protein, 137 aa, Homo sapiens
  misc_feature: NA.3.72.G06.1.454.light.4.zerom50-aa
  MOD_RES (136)..(136): Any amino acid
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVXS

SEQ ID NO: 795301 - protein, 140 aa, Homo sapiens
  misc_feature: NA.21.8.A08.1.454.light.4.zerom50-aa
MAWTPLLLPLLTFCTVSEASYELTQPPSVSVSPGQTARITCSGDSLPKEYTCWFQQKSGQAPVLVIHEASRRHSGIPERFSASSSGTVATLTISGAQVDDEADYYCYAPDSSGHQGVFGGGTKLTVLGQPKAAPSVTLRP

SEQ ID NO: 795302 - protein, 146 aa, Homo sapiens
  misc_feature: NA.10.70.G04.1.454.light.4.zerom50-aa
MAWSPLLLTLLAHCTGSWAQSVLTQPPSVSGAPGQRVTISCTGSSSNIGAGYDVHWYQQLPGTAPTLLIYGDTNRPSGVPERFSGSKSGTSASLAITGLQAEDEADYYCQSHDNSLSVWVFGGGTKLTVLSQPKAAPSVTLFPPSS

SEQ ID NO: 795303 - protein, 137 aa, Homo sapiens
  misc_feature: NA.12.50.E06.1.454.light.4.zerom50-aa
METPAQLLFLLLLWLPDTTGEIVLTQSPGTLSLSPGERVTLSCRASQSVSGNYLAWYQQKPGQAPRLVIYGASSRATGIPDRFSGSGSGTDFTLTISRLEPEDFAVYYCQQYGGSRRFTFGPGTKVDVKRTVAAPSV

SEQ ID NO: 795304 - protein, 138 aa, Homo sapiens
  misc_feature: NA.51.44.D11.1.454.light.4.zerom50-aa
MDMRVPAQLLGLLLLWLRGARCDIQMTQSPSSLSASVGDRVTINCRASQSISRYLNWYQQKPGKAPKVLIYAASSLQSGVPSRFSGSGSGTDFTLTISSLQLADSATYYCQQSFNSPRTFGQGTKVEIKRTVAAPSVF

SEQ ID NO: 795305 - protein, 137 aa, Homo sapiens
  misc_feature: NA.16.71.G05.1.454.light.4.zerom50-aa
METPAQLLFLLLLWLPDTTGEIVLTQSPGTLSLSPGERATLSCRASQSVTSRYLAWYQQKPGLAPRLLIYGASSRATGIPDRFSGSGSGTDFTLTLSRLEPEDFAVYYCQQYGRAPYTFGQGTKLEIKRTVAAPSVF

SEQ ID NO: 795306 - protein, 145 aa, Homo sapiens
  misc_feature: NA.26.77.G11.1.454.light.4.zerom50-aa
MVLQTQVFISLLLWISGARGDIVMTQSPDSLAVSLGERATINCKSSQSVLYRSDNKNYLAWYQQKPGQPPNLLIYWASTRESGVSGRFSASGSGTEFTLTISSLQAEDVAVYYCQQYFRAPYTFGQGTQVEIRRTVAAPSVFIFP

SEQ ID NO: 795307 - protein, 137 aa, Homo sapiens
  misc_feature: NA.17.26.C04.1.454.light.4.zerom50-aa
MDMRVPAQLLGLLLLWLRGARCDIQMTQSPSSLSASVGDRVTITCRASQSISSYLNWYQQKPGKAPKLLIFAASSLQSGVPSRFSGSGSGTDFTLTISSLQPEDFATYYCQQSYNTPRLTFGGGTKVEIKRTVAAPS

SEQ ID NO: 795308 - protein, 139 aa, Homo sapiens
  misc_feature: NA.41.74.G08.1.454.light.4.zerom50-aa
MVLQTQVFISLLLWISGAYGDIVMTQSPDSLAVSLGGRATINCKSSQTILYGSYNKNDLAWYQQKPGQPPKLLIYWASNRISGVPDRFNASGSGTDFTLTISSLQAEDVAVYYCHQYYTTPWTFGQGTKVELKRTVAAP

SEQ ID NO: 795309 - protein, 139 aa, Homo sapiens
  misc_feature: NA.21.26.C04.1.454.light.4.zerom50-aa
METPAQLLFLLLLWLPDTTGEIVLTQSPDTLSLSPGERATLSCRASQIVGNNYLAWYQQKPGQAPRLLIHTASKRATGIPDRFSGSGSGTDFTLTITRLEPDDFAVYYCHQHAFAPLTFGGGTRVEIKRTVAAPSVFIP

SEQ ID NO: 795310 - protein, 141 aa, Homo sapiens
  misc_feature: NA.22.26.C04.1.454.light.4.zerom50-aa
MDMRVPAQLLGLLLLWLPGAKCDIQMTQSPSTLAASVGDRVTITCRASQNINSWLAWYQQKPGKAPILLIHKASTLESGVPSRFSGTGSGTEFTLTINSLQPDDLATYYCQPYSTYSVTFGQGTRLEIKRTVAAPSVFIFP

SEQ ID NO: 795311 - protein, 142 aa, Homo sapiens
  misc_feature: NA.10.80.H03.1.454.light.4.zerom50-aa
MAWTVLLLGLLSHCTASATSYVLSQPPSVSVAPGETARITCGGDSIESEAVHWYQQRPGQAPVLVLYDDSDRPSGIPERFSGSNSGNTATLTITRVEAGDEADYYCQVWYFSSIHPGVFGGGTKLTVLGQPKAAPSVTLFPT

SEQ ID NO: 795312 - protein, 134 aa, Homo sapiens
  misc_feature: NA.53.55.E11.1.454.light.4.zerom50-aa
  MOD_RES (133)..(133): Any amino acid
MAWIPLFLGVLAYCTGSVASYELTQPPSVSVSPGQTASITCSGDKLEDKYTCWYQQKPGQSPVLVIYQDRKRPSGIPERFSGSNSGNTATLTISGTQAMDEADYYCQAWDSNPDWVFGGGTKLTVLGQPKAPXP

SEQ ID NO: 795313 - protein, 142 aa, Homo sapiens
  misc_feature: NA.9.28.C06.1.454.light.4.zerom50-aa
MSVPTMAWRMLLLGLLAYGSGVDSQTVVTQEPSFSVSPGGTVTLTCGLSSGSVSTFYYPTWYQQTPGQAPRMIIYSTNTRSSGVPDRFSGSILGNKAALTITGAQADDESDYYCVLYMDRGIWMFGGGTKLTVLGQPKACPP

SEQ ID NO: 795314 - protein, 139 aa, Homo sapiens
  misc_feature: NA.9.3.A03.1.454.light.4.zerom50-aa
MEAPAQLLFLLLLWLPVTTGEIVLTQSPATLSLSPGERATLSCRASQSVGTYVAWYQQNPGQAPRLLIYDASNRATGVPARFSGSGSGTDFTLTISSLEPEDFAFYYCQQRAKWLLTFGGGTKVETRRTVAAPSVFIFP

SEQ ID NO: 795315 - protein, 136 aa, Homo sapiens; identical to SEQ ID NO: 795258
  misc_feature: NA.48.65.F10.1.454.light.4.zerom50-aa

SEQ ID NO: 795316 - protein, 140 aa, Homo sapiens
  misc_feature: NA.22.46.E02.1.454.light.4.zerom50-aa
MAWALLLLSLLTQGTGSWAQSALTQPRSVSGSPGQSVTISCTGTSSDVGAYNYVSWYQHHPGKAPQLLIFGVNNRPSGVPDRFSGSKSGNTASLTISGLQADDEGDFYCCSYAGNYNMVFGGGTKVTVLGQPKARPLGHS

SEQ ID NO: 795317 - protein, 143 aa, Homo sapiens
  misc_feature: NA.53.66.F11.1.454.light.4.zerom50-aa
MAWTVLLLGLLSHCTVSVTSYVLTQPPSVSVAPGKTAAITCGGHNIGTKRVHWYQQMPGQAPVVVYYDVDRPSGIPERFSGSTSGNTATLTISRVEAGDEADYFCQIWDSNFDIPVFGGGTKLTVLGQPKAAPSVTLFPPSSR

SEQ ID NO: 795318 - protein, 137 aa, Homo sapiens
  misc_feature: NA.13.8.A08.1.454.light.4.zerom50-aa
MDMRVPAQLLGLLLLWLRGARCDIQMTQSPSSLSASVGDRVTVTCRASQTIDKYVNWYQQKPGEAPKLLIYTASTLSGGVPSRFRGSGSGTDFTLTITSLQPEDCATYYCQQSYGTSYTFGQGTRLEIKRTVAAPSV

SEQ ID NO: 795319 - protein, 141 aa, Homo sapiens
  misc_feature: NA.3.61.F06.1.454.light.4.zerom50-aa
MAWIPLFLGVLAYCTGSGASYQLTQPPSVSVSPGRTAVITCSANDLGERYVSWYLQRPGHSPILVLYQNRKRPSGIPERFSGSKSGDTATLTLTGAQAIDEGDYYCQAWDSTTAVFGGGTKLTVLGQPKAAPSVTLFPPSS

SEQ ID NO: 795320 - protein, 135 aa, Homo sapiens
  misc_feature: NA.7.81.H04.1.454.light.4.zerom50-aa
MDMRVPAQLLGLLLLWLRGARCGIQMTQSPSSLSASVGDRVTIICRASQSISDSLNWYQKKPGKAPKLLISAAASLQSGVPSRFSGSGSGTDFTLAISSLQPDDFATYYCQQSSTTPITFGPGTEVHMKRTVAAP

SEQ ID NO: 795321 - protein, 137 aa, Homo sapiens
  misc_feature: NA.41.29.C07.1.454.light.4.zerom50-aa
MASFPLLLTLLTHCAGSWAQSVLTQPPSASGTPGQRVTISCSGSSSNIGSNTVNWYQQLPGTAPKLLIYVNNKRPSGVPDRFSGSKSGTSASLAISGLQSEDEADYYCAAPDGSLNGWVFGGGTKLTVLGQPKAAPR

SEQ ID NO: 795322 - protein, 136 aa, Homo sapiens; identical to SEQ ID NO: 794946
  misc_feature: NA.14.56.F01.1.454.light.4.zerom50-aa

SEQ ID NO: 795323 - protein, 137 aa, Homo sapiens
  misc_feature: NA.4.19.B08.1.454.light.4.zerom50-aa
MDMRVPAQLLGLLLLWLPGADCDIQLTQSPSTLSASIGDRVTITCRASQNINRWLAWYLQRPGRAPKLLIYDASTLHTGVPPTFSGSGSGTEFTLTISSLQPDDLGTYYCQQYNSYWTFGQGTKVEFKRTVAAPSVF

SEQ ID NO: 795324 - protein, 136 aa, Homo sapiens
  misc_feature: NA.3.31.C09.1.454.light.4.zerom50-aa
MEAPAQLLFLLLLWLPDTTGEIVLTQSPATLSLSPGERATLSCRASQSVSNYLAWYQQKPGQAPRLLIYDASNRATGIPARFSGSGSGTDFTLTISSLEPEDFAVYYCQQRSNWPLTFGGGTKVEIKRTVAAPSVF

SEQ ID NO: 795325 - protein, 145 aa, Homo sapiens
  misc_feature: NA.52.10.A10.1.454.light.4.zerom50-aa
  MOD_RES (140)..(141): Any amino acid
MEAPAQLLFLLLLWLPDGTGESVLTQSPGTLSLSPGERATLSCRASQNITSYLAWYQQKPAQAPRLLIYDASNRATGIPARFSGSGSGTDFTLTISNLEPEDFAVYYCQQRSKWRFGQGTRLEVKRTVAAPSVFIFPPSXXPTLT

SEQ ID NO: 795326 - protein, 135 aa, Homo sapiens
  misc_feature: NA.3.2.A02.1.454.light.4.zerom50-aa
MDMRVPAQLLGLLLLWLRGARCDIQMTQSPSSLSASVGDRVTLTCRPSHSISIYLNWYQQKPGKAPNLLIYTASSLQSGVPSRFSGSGSGTEFTLTISSLQPEDFATYYCQQSYSIPPTFGGGTKVEIKRTVAAP

SEQ ID NO: 795327 - protein, 144 aa, Homo sapiens
  misc_feature: NA.49.40.D07.1.454.light.4.zerom50-aa
MAWTALLLSLLAHFTGYVASYEVIQPRSVSVALGQTATITCDGENNRNKNIHWYQQKPGQAPVLVLYRDFNRPAGIPERFSGSTSGNRATLTIIRAQGDDEADYYCQVEDAKLVIFGGGTKLTVLGQPKAAPSVTLFPPSSLSY

SEQ ID NO: 795328 - protein, 137 aa, Homo sapiens
  misc_feature: NA.41.61.F06.1.454.light.4.zerom50-aa
MDMRVPAQLLGLLLLWFPGSRCDIQMTQSPSSVSASVGDRVTITCRATQGISSWLAWYQQKPGKAPKLLIYAASSLQSGVPSRFSGSGSGTDFTLTISSLQPEDFATYYCQQGNSFPLTFGGGTKVEIKRTVAAPSS

SEQ ID NO: 795329 - protein, 135 aa, Homo sapiens; identical to SEQ ID NO: 795203
  misc_feature: NA.12.51.E07.1.454.light.4.zerom50-aa

SEQ ID NO: 795330 - protein, 140 aa, Homo sapiens
  misc_feature: NA.40.3.A03.1.454.light.4.zerom50-aa
METPAQLLFLLLLWLPDTTGEIVLTQSPGTLSLSPGERATLSCRASETVTVNYLAWYQQKPGQAPRLLISAASYRATGIPDRFSGSGSGTDFTLSISRLEPEDFAIYYCHQYGSSPLTFGGGTKVEIKRTVAAPSVFIFP

SEQ ID NO: 795331 - protein, 148 aa, Homo sapiens
  misc_feature: NA.52.7.A07.1.454.light.4.zerom50-aa
MAWALLLLTLLTQDTGSWAQSALAQPASVSGSPGQSITISCAGTNNDVGSYKLVSWYQQHPGKAPKLIIYEVTKRPSGVSNRFSGSKSGDTASLTISWLQAEDEADYFCCSYAGSSNYVFGSGTTVTVLGQPKANPTVTLFPPSSIRT

SEQ ID NO: 795332 - protein, 137 aa, Homo sapiens
  misc_feature: NA.5.47.E03.1.454.light.4.zerom50-aa
METPAQHLFLLLLWLPDTAGEIVLTQSPGTLSLSPGERATLSCRASQSVSGDYLAWYQQKPGQTPRLLIFGVSSRATGIPRRFSGSGSGTDFTLTISRLEPEDFAVYYCQQYGLSPFTFGGGTKVENKRTVAAPSSF

SEQ ID NO: 795333 - protein, 138 aa, Homo sapiens
  misc_feature: NA.51.49.E05.1.454.light.4.zerom50-aa
MEAPAQLLFLLLLWLPDTIGEIVLTQSPATLSVSPGERVTLSCRASENIDIYLVWYQQKPGQPPRLLVHSASARAAGVPARFRGSRSGTEFTLTITNLQSEDFGLYYCQQYNDWPRTFGQGTEGGNTRRTVAAPSVFY

SEQ ID NO: 795334 - protein, 137 aa, Homo sapiens
  misc_feature: NA.16.70.G04.1.454.light.4.zerom50-aa
MEAPAQLLFLLLLWLPDTTGEIVMTQSPATLSVSPGERATLSCRATQSITSNLAWYQQKPGQAPRLLIYGASTRATGIPARFSGSGSGTEFTLTISSLQSEDFAVYYCQQYNDWPPLTFGGGTKVEIKRTVAAPSVF

SEQ ID NO: 795335 - protein, 143 aa, Homo sapiens
  misc_feature: NA.8.10.A10.1.454.light.4.zerom50-aa
MEAPAQLLFLLLLWLPDTTGEIVLTQSPATLSLPPGERATLSCRASLSVSNLAWYQQKPGQAPRLLISDTSNRATGIPARFSGSGSGTDFTLTISSLEPEDFALYYCQQRSNWPFTFGPGTKVDIKRTVAAPSVFIFPPSETR

SEQ ID NO: 795336 - protein, 155 aa, Homo sapiens
  misc_feature: NA.21.81.H04.1.454.light.4.zerom50-aa
MAWALLFLTLLTQGTGSWAQSALTQPASVSGSPGQSITISCTGTSGDVGLYDYVSWYQQYPGKAPKLIIYDVSNRPSGVSNRFSGSKSGNTASLTISGLQADDEADYYCRSYTISNTYVFGTGTKITVLGQPKANPTVYDPNRNPNPQPLRSTLP

SEQ ID NO: 795337 - protein, 134 aa, Homo sapiens
  misc_feature: NA.17.36.D03.1.454.light.4.zerom50-aa
MEAPAQLLFLLLLWLPDTTGEIVLTQSPATLSLSPGERATLSCRASQSVSSYLAWYQQKPGQSPRLLIYDASNRATGIPARFSGSGSGTDFILTISSLEPEDFAVYYCQQRSNWLITFGQGTRLEMKRTVAAPT

SEQ ID NO: 795338 - protein, 136 aa, Homo sapiens
  misc_feature: NA.16.72.G06.1.454.light.4.zerom50-aa
MEAPAQLLFLLLLWLPDTSGETVMTQSPATLSVSPGERVTLSCRASQSVSSNLAWYQQKPGQAPRLLIYDASTRATGIPARFSGSGFGTEFTLTISSLQSEDFAVYYCQQYNNWPPVTFGGGTKVEIKRTVAAPSS

SEQ ID NO: 795339 - protein, 142 aa, Homo sapiens
  misc_feature: NA.3.74.G08.1.454.light.4.zerom50-aa
  MOD_RES (74)..(74): Any amino acid
LARQVMVTLSPTDADRVEGDWVIQMTQSPSTLSASVGDRVTITCRASQSISHFLAWYQQRPGKAPNLLIYDASXLEGGVPSRFSGSGSGTEFTLTISSLQPDDFATYYCQHYVSSPWTFGQGTKVEIKRTVAAPSVFIFPPL

SEQ ID NO: 795340 - protein, 140 aa, Homo sapiens
  misc_feature: NA.41.3.A03.1.454.light.4.zerom50-aa
METPAQLLFLLLLWLPGATGEIVLTQSPGTLSFSPGERATLSCRASQSVDNQYFAWYQQKPGQAPRLLMDGASSRATGIPDRFGGSGSGTDFTLTISSLEPEDFVVYYCQQYLTTPGSFGQGTKLEIKRTVAAPSVFIFP

SEQ ID NO: 795341 - protein, 137 aa, Homo sapiens
  misc_feature: NA.14.66.F11.1.454.light.4.zerom50-aa
GAWTPLWLALLTLCIGSVVSSELTQDPAVSVALGQTVRITCQGDGLGSYYASWYQQKPGQAPVLVIYGKNIRPSGIPDRFSGSNSGNTASLTITGAQAEDEADYYCNSRDSSANPNYVFGTGTKVTVLGQPKANPTY

SEQ ID NO: 795342 - protein, 141 aa, Homo sapiens
  misc_feature: NA.16.6.A06.1.454.light.4.zerom50-aa
MVLQTQVFISLLLWISGAYGDIVMTQSPDSLAVSLGERATINCRSSQSVLYSSNNKNYLAWYQQKPGQSPKLLIYWASTRESGVPDRFSGSGSGTDFTLTISSLQVEDVAVYYCQQYYTTPLTFGQGTKVEIKRTVAAPSS

SEQ ID NO: 795343 - protein, 138 aa, Homo sapiens
  misc_feature: NA.41.10.A10.1.454.light.4.zerom50-aa
MLPSQLIGFLLLWVPASRGEIVLTQSPGFQSVTPKEKVTITCRASQSIDSDLHWYQQKPNQSPKLLIKYSSQSISGVPSRFSGSGSGTDFTLTISSLEAEDAATYYCHQSRSLPQTFGQGTKVEIKRTVAAPSVFIFP

SEQ ID NO: 795344 - protein, 138 aa, Homo sapiens
  misc_feature: NA.14.68.G02.1.454.light.4.zerom50-aa
MDMRVPAQLLGLLLLWLSGARCDIQMTQSPSSLSASVGDRVTITCQASQDIRKYLNWYQQKPGKAPKLLIFDASNLETGVPSRFRGSGSGTDFSFTISSLQPEDIGTYYCQQYDNLPLTFGGGTKVDIKRTVAAPSSF

SEQ ID NO: 795345 - protein, 141 aa, Homo sapiens
  misc_feature: NA.21.15.B04.1.454.light.4.zerom50-aa
MVLQTQVFISLLLWISGAYGDFVMTQSPDSLAVSLGERATINCKSSPSVLSSSDNKNYLAWYQQQPGQRPKLLIYWASVRESGVPDRFVGSGSGTDFTLTISSLQAEDVAVYFCMQHYAAPLTFGGGTKVEIKRTVAAPSS

SEQ ID NO: 795346 - protein, 138 aa, Homo sapiens
  misc_feature: NA.11.71.G05.1.454.light.4.zerom50-aa
MEAPAQLLFLLLLWLPDSTGEIVLTQSPATLSLSPGERATLSCRASQSVNSYLAWYQQKPGQTPRLLIYDASNRATGTPARFSGSGSGTDFTLTISSLEPEDFAVYYCQQRIDWITFGQGTRLEIKRTVAAPSVFILP

SEQ ID NO: 795347 - protein, 146 aa, Homo sapiens
  misc_feature: NA.5.68.G02.1.454.light.4.zerom50-aa
MAWALLLLTLLTQGTGSWAHSALTQPPSASGSPGQSVTISCTGTSSDEDFYKYVSWYQQRPGKAPKLMIYEVIKRPSGVPHRFSGSKSGNTASLTVSGLQAEDEATYYCSSYADSNNFIFGGGTRLTVLGQPKAAPSVTLFPPSSV

SEQ ID NO: 795348 - protein, 138 aa, Homo sapiens
  misc_feature: NA.19.15.B04.1.454.light.4.zerom50-aa
  MOD_RES (138)..(138): Any amino acid
METPAQLLFLLLLWLPGSETTGEIVLTQSPGTLSLSPGERATLSCSSSQNIQSYYIAWYQQKPGQAPRFLIYAGSHRATGIPDRFSGSGSGTDFTLIISRLEPEDFAVYYCQQYGSSPLSFGQGTKVEMKRTVAAPSX

SEQ ID NO: 795349 - protein, 141 aa, Homo sapiens
  misc_feature: NA.40.45.E01.1.454.light.4.zerom50-aa
MEAPAQLLFLLLLWLPVITGEIVLTQSPATLSFSPGERASLSCRASQSINTFLAWYQQKPGQAPRLLIYDASNRATGVPARFSGSGSGTDFTLTISSLEPEDFAVYYCQQRANWPLTFGGGTKVEIKRTVAAPSVFIFPPM

SEQ ID NO: 795350 - protein, 136 aa, Homo sapiens
  misc_feature: NA.40.69.G03.1.454.light.4.zerom50-aa
MEAPAQLLFLLLLWLPDSAGEIVMTQSPATLSVSPGKRATLSCRASESVDTYLAWYQHRPGQAPRLLISGASTRATGIPVRFSGSGSGTEFTLTISSLQSEDVAVYSCQQYNDWPYTFGQGTKLEIKRTVAAPFVF

SEQ ID NO: 795351 - protein, 135 aa, Homo sapiens
  misc_feature: NA.26.70.G04.1.454.light.4.zerom50-aa
MDMRVLAQLLGLLLLCFPGARCDIQMTQSPSSLSASVGDRVTITCRASQGISDFLAWFQQKPGKAPKSLIYAASTLEGGVPSRFSGSGSGTEFTLNISSLQPEDFATYYCQQYNDYPITFGRGTRLETKRTVAAP

SEQ ID NO: 795352 - protein, 141 aa, Homo sapiens
  misc_feature: NA.9.52.E08.1.454.light.4.zerom50-aa
MEAPAQLLFLLLLWLPENAGEIVLAQSPATLSMSPGERATLSCRASQSVGTSLLWYQQKPGQAPRLLIYDASTRATGIPARFSGSGSGTDFTLTISSLDPEDFAVYYCQQRTNWPLSLTFGGGPKVELKRTVAAPSVFIFP

SEQ ID NO: 795353 - protein, 140 aa, Homo sapiens
  misc_feature: NA.12.82.H05.1.454.light.4.zerom50-aa
METPAQLLFLLLLWLPETTGEIVLTQSPGTLSLSPGERATLSCRASENVNNRYLAWYQQKPGQAPRLLMYVTSSRATGIPDRFTGSGSGTDFTLTITRLEPEDFAVYYCQQYGSAPYTFGQGSKLEMKRTVAAPSVFIFP

SEQ ID NO: 795354 - protein, 141 aa, Homo sapiens
  misc_feature: NA.3.27.C05.1.454.light.4.zerom50-aa
MVLQTQVFISLLLWISGAYGDIVMTQSPDSLAVSLGERATINCKSSQSVLYSSDNKNYLAWYQQKPGQPPKLLIYWASTRESGAPDRFNGSGSGADFTLTISSLQAEDVAVYYCQQYYTPLPTFGQGTKVEIKRTVAAPSV

SEQ ID NO: 795355 - protein, 140 aa, Homo sapiens
  misc_feature: NA.10.64.F09.1.454.light.4.zerom50-aa
MEAPAQRLFLLLLWLPDITAGEIVLTQSPATLSLSPGERATLSCRASQSVSTNLVWYQQKPGQAPRLLIYDASTRATGIPARFSGSGSGTDFTLTITGLDPEDFAVYYCQQRSSWPLSLTFGGGTKVEIKRTVAAPSVFY

SEQ ID NO: 795356 - protein, 138 aa, Homo sapiens
  misc_feature: NA.9.64.F09.1.454.light.4.zerom50-aa
MDMRVPAQLLGLLLLWLPGAKCDIQMTQSPSTLSASVGDRVTITCRSTQSMSTWLAWYQQKPGKAPKLLIYDASILESGVPSRFSGSGSGTEFTLTISSLQPDDFATYYCQRHNWYFGPGTKVDVKRTVAAPSVFIFP

SEQ ID NO: 795357 - protein, 136 aa, Homo sapiens
  misc_feature: NA.4.40.D07.1.454.light.4.zerom50-aa
METPAQLLFLLLLWLPDTTGEVVLTQSPGTLSLSPGERATLSCRTSQSDTNNFLAWYQQKAGQAPRLLIYGASIRATGIPDRFSGSGSGTDFTLIINRLEPEDSAVYYCHQYGGARVFGGGPKVDIKRTVAAPSVL

SEQ ID NO: 795358 - protein, 135 aa, Homo sapiens
  misc_feature: NA.4.8.A08.1.454.light.4.zerom50-aa
  MOD_RES (135)..(135): Any amino acid
MAWIPLFLGVLAYCTGSVPSYELTQPPSVSVSPGQTASISCSGDRLENKFVTWYQQKPGQSPVLVIYQDKERPSGIPERISGSNSGNTATLTISGTQAMDEGDYYCQAWDSPYVVFGGGTKLTVLGQPKAAPSVX

SEQ ID NO: 795359 - protein, 149 aa, Homo sapiens
  misc_feature: NA.2.1.A01.1.454.light.4.zerom50-aa
  MOD_RES (1)..(1): Any amino acid
XAWALLFLTLLTQGTGSWAQSALTQPASVSGSPRQTLNISCTGTSSDVGGYDSVSWYQQHPARAPKLLIYDVRNRPSGASTRFSGSKSGNTASLTISWVQAEDEAIYYCSSYTSSSTVVFGGGTKLTVLGQPKARPLGHSSFPPSSVER

SEQ ID NO: 795360 - protein, 143 aa, Homo sapiens
  misc_feature: NA.9.16.B05.1.454.light.4.zerom50-aa
MAWALLLLTLLTQGTGSWAQSALTQPPSASGSPGQSVTISCAGATNDFGGFNSVSWYQKHPSKAPKLLIYQSTKRPSGVPGRFSGSKSDDTASLTVSGLQAEDEADYYCTSYAGYGSHVIFGGGTKLTVLSQPKAAPSVTLVP

SEQ ID NO: 795361 - protein, 140 aa, Homo sapiens
  misc_feature: NA.43.25.C03.1.454.light.4.zerom50-aa
MRLPAQLLGLLMLWVPGSSGDVVMTQSPLSLPVTLGQPASMTCKSSQSLVHSDGNTYLIWFQQRPGQSPRRLIYKVSDRDSGVPDRFSGSGSGTDFTLKISRVEAEDVGVYYCMQGTHWPVTFGQGTRLEIKRTVAAPSV

SEQ ID NO: 795362 - protein, 139 aa, Homo sapiens
  misc_feature: NA.3.21.B10.1.454.light.4.zerom50-aa
MAWTPLWLTLLTLCIGSVVSSELTQDPAVSVALGQTVRITCQGDSLRSYYASWYQQKPGQAPVLVIYGKNNRPSGIPDRFSGSSSGNTASLTITGAQAEDEADYYCNSRASSGNIVIFGGGTKVTVLRQPKAAPSVHSR

SEQ ID NO: 795363 - protein, 136 aa, Homo sapiens
  misc_feature: NA.7.76.G10.1.454.light.4.zerom50-aa
MDMRVPAQLLGLLLLWFPGSRCDIQMTQSPSSVSASIGDRVTIICRASQHITSRLAWYQQKPGRAPKLLISAASSLQSGVPSRFSGSGYGTYFTLAISSLQPEDFATYYCQQANSFPLTFGGGPKVEIKRTVAAPI

SEQ ID NO: 795364 - protein, 145 aa, Homo sapiens
  misc_feature: NA.52.16.B05.1.454.light.4.zerom50-aa
MAWTVLLLGLLSHCTDYVTSYVLTQPPSASVAPGQTATITCEGNYIERKSVHWYQQKPGQAPVLVLHDDSDRPSGIPEGFSGSNSGNTATLTISRVEAGDEADYYCQVWDRDSDHWVFGGGTKLTVLSQPKARPLGHSVPALLYT

SEQ ID NO: 795365 - protein, 142 aa, Homo sapiens
  misc_feature: NA.8.71.G05.1.454.light.4.zerom50-aa
MDMRVPAQLLGLLLLWLRGASCDIQLTQSPSSLSASVGDSVTITCRASQSINNYLNWYQQKPGKAPKYLVYTASTLQSGVPSRFSGSGFGTVFTLTISSLEPEDFATYYCQQTYNIPRTFGQGTKVEIKRTVAAPSVFIFPP

SEQ ID NO: 795366 - protein, 137 aa, Homo sapiens
  misc_feature: NA.11.25.C03.1.454.light.4.zerom50-aa
MAWIPLFLGVLAYCTGFVASDELTQPPSVSVSPGQTARIPCSGIELRDKYTCWYQQKPGQSPVLVIYQDVKRPSGIPERFSGSNSGNAATLTISGTQAMDEADYYCQAWDSSTARYVFGTGTKVTVLSQPKANPKPP

SEQ ID NO: 795367 - protein, 139 aa, Homo sapiens
  misc_feature: NA.9.88.H11.1.454.light.4.zerom50-aa
MAWALLLLTLLTQGTGSWAQSALTQPPSASGSPGQSVTISCTGSGTDVGRFVYVSWYQQHPGKGPKLVLYEASKRPSGIPDRFSGSRSGNTASLTVSGLQPDDEAIYYCSAYAGSNTLVFGGGTTVTVLSQPKARPLGH

SEQ ID NO: 795368 - protein, 137 aa, Homo sapiens
  misc_feature: NA.8.75.G09.1.454.light.4.zerom50-aa
MASFPLLLTLLTHCAGSWAQSVLTQPPSASGTPGQRVTISCSGSSSNIGTNTVNWYQQLPGTAPKLLIYHSDQRPSGVPDRFSGSKSATSASLAISGLQSEDEADYYCAAWDDSLNGLVFGGGTKVTVLGQPKARPL

SEQ ID NO: 795369 - protein, 141 aa, Homo sapiens
  misc_feature: NA.51.2.A02.1.454.light.4.zerom50-aa
MAWTVLLLGLLSHCTGSVTSYVLSQPPSVSVAPGQTARITCGGNNIGSKTVHWYQQKPGQAPVLVVYDDADRPSGIPERFSGSSSENTATLSISRVEAGDEADYYCQVWDTSSDHVFGPGTKVTVLGQPKANPTVTLFPPF

SEQ ID NO: 795370 - protein, 141 aa, Homo sapiens
  misc_feature: NA.10.7.A07.1.454.light.4.zerom50-aa
MEAPAQLLFLLLLWLPDTTGEIVLTQSPATLSLSPGERATLSCRASQSIRSSLAWYQQKYGQAPRLLIYETSNRATAIPARFSGSGSGTDFTLIISGLEPEDSAVYYCQHRTEWPPQPTFGGGTKVEIKRTVAAPSVFIFP

SEQ ID NO: 795371 - protein, 136 aa, Homo sapiens
  misc_feature: NA.16.12.B01.1.454.light.4.zerom50-aa
MAWIPLFLGVLAYCTVSVASYQLTQPPSVSVSPGQTASIICSGDNLGDKYTFWYQQKAGQSPVLVIFQDTERPSEIPERFSGSNSGNTATLTISGAQTMDEADYYCQAWDSNSVIFGGGTKLTVLGQPKAAPSVTL

SEQ ID NO: 795372 - protein, 134 aa, Homo sapiens
  misc_feature: NA.52.12.B01.1.454.light.4.zerom50-aa
MAWIPLFLGVLAYCTGSVASYELTQPPSVSVSPGQTASITCSGDKLGDKYVSWYQQKPGQSPALVIYQDTKRRSGIPERFSGSNSGDTATLTISGTQTLDEADYYCQAWDSSTGVFGGGTKLTVLGQPKARPLG

SEQ ID NO: 795373 - protein, 139 aa, Homo sapiens
  misc_feature: NA.12.26.C04.1.454.light.4.zerom50-aa
MVLQTQVFISLLLWISGAYGDIVMTQSPDSLAVSLGERATINCKSSQSVLFNSNNENYLAWYQQKPGQPPKLLIYWASTRESGVPDRFSGSGSETDFTLTISSLQAEDVAVYFCQQYYHTPLTFGGGTKVEIKRTVAAP

SEQ ID NO: 795374 - protein, 142 aa, Homo sapiens
  misc_feature: NA.11.11.A11.1.454.light.4.zerom50-aa
MVLQTQVFISLLLWISGACGDILMTQSPDILPVSLGERATIECKSSETLLYSVNDKDYLAWYQQKPGQPPKLLISWASTRAPGVPDRFSGSGSGTDFTLTISNLQAEDVAVYYCQQYCEAPLTFGGGTAVEIRRTVAAPSVF

SEQ ID NO: 795375 - protein, 139 aa, Homo sapiens
  misc_feature: NA.4.3.A03.1.454.light.4.zerom50-aa
METPAQLLFLLLLWLPDSAGEVVLTQSPGTLSLSPGERATLSCRASESLSGDYLAWYQQKPGQSPRLLISGVSFRATGIPDRFRGSGSGTDFTLTISRLEPEDFALYFCQQYVFAPFTFGGGTKVENKRTVAAPSVFIP

SEQ ID NO: 795376 - protein, 140 aa, Homo sapiens
  misc_feature: NA.13.9.A09.1.454.light.4.zerom50-aa
MAWIPLFLGVLAYCTESMASYELTQPPSMSVSPGQTAYITCSGDVLTNEYGSWYQQKAGQPPVLLIFQNTRRPSGVPERFSGSASGNTVTLTISGTQPIDEAVYFCQAWDNSVLFGGGTSLTVLGQPKARPLGHSRSLPP

SEQ ID NO: 795377 - protein, 143 aa, Homo sapiens
  misc_feature: NA.53.44.D11.1.454.light.4.zerom50-aa
MAWTVLLLGLLSHCTGSVTSYVLAQPTSVSVAPGQTATITCGGEDIGSKRVHWYQQKSGQAPVLVIYGGRNRPSWIPERLSGSNSGNMATLMIRRVEAGDEADYYCQVWDSSSDRNWVFGGGTKLTVLGQPKAAPSVTLFPPF

SEQ ID NO: 795378 - protein, 141 aa, Homo sapiens
  misc_feature: NA.4.66.F11.1.454.light.4.zerom50-aa
MDMRVPAQLLGLLLLWFPGSRCDIQLTQSPSFVSASVRDRLTITCRASQDISTNLAWYQQKPGRAPKLLIYGASSLQSGVPSRFRGSGSGTDFTLTISGLQPEDYATYYCQSSNSFPRTFGQGTKVEIKRTVAAPSVFIFP

SEQ ID NO: 795379 - protein, 137 aa, Homo sapiens
  misc_feature: NA.10.82.H05.1.454.light.4.zerom50-aa
MTCSPLLLTLLIHCTGSWAQSVLTQPPSVSAAPGQKVTISCSGGSSNIGNSYVSWYQHIPGGAPKLLIYEDDKRPSGIPDRFSGSKSGTSATLGIAGLQTGDEADFYCGTWDTSLHGVVFGGGTKLTVLSQPKARPP

SEQ ID NO: 795380 - protein, 142 aa, Homo sapiens
  misc_feature: NA.17.41.D08.1.454.light.4.zerom50-aa
METPAQLLFLLLLWLPDTTGEIVLTQSPGTLSLSPGETATLSCRASQSVFKNYLAWYQQKPGQAPRLLIYGASTRATGIPDRFSGGGSGTEFTLTITSLEPEDFALYHCQQYGGTPLTFGGGAKVEIKRTVAAPSVFIFPPF

SEQ ID NO: 795381 - protein, 144 aa, Homo sapiens
  misc_feature: NA.21.30.C08.1.454.light.4.zerom50-aa
MAWTPLLLPLLTFCTVSEASYELTQPPSVSVSPGQTARITCSGDALPKNYVFWYQQKSGQAPVLVIHEDRRRPSGIPERFSGSNSGTVATLILSGAQVEDEADYYCYSADSSGHQGAFGGGTRLTVLGQPKAAPSVTLFPPSSR

SEQ ID NO: 795382 - protein, 141 aa, Homo sapiens
  misc_feature: NA.3.70.G04.1.454.light.4.zerom50-aa
MEAPAQLLFLLLLWLPDNTGQTVLTQSPATLSLSPGETATLSCRASQSVRGHLAWYQQKPGQPPSLLIYGAHNRATGIPARFSGSGSGTDFTLIISRLEPEDFAVYYCQQGYFWPTFGPGTKVDIKRTVAAPSVFIFPPSR

SEQ ID NO: 795383 - protein, 135 aa, Homo sapiens
  misc_feature: NA.3.49.E05.1.454.light.4.zerom50-aa
METPAQLLFLLLLWLPDTTAEIVLTQSPGTLSLSPGERATLSCRASESVNNRYLGWYQQKPGQAPRLLIYSASSRATGIPDRFSGSGSGTDFTLTITRLEPEDFAVYFCQQYGDSLAFGQGTKVEIKRTVAAPSV

SEQ ID NO: 795384 - protein, 139 aa, Homo sapiens
  misc_feature: NA.9.81.H04.1.454.light.4.zerom50-aa
MAWALLLLTLLTQGTGSWAQSALTQPPSASGSPGQSVTISCTGTSSDIGAYNYVSWYQQHPGKVPKLMIYEVNKRPSGVPDRFSGSKSGNTASLTVSGLQADDEADYYCSSYAGTHNVFGSGTTVTVLGQPKANPTVTS

SEQ ID NO: 795385 - protein, 142 aa, Homo sapiens
  misc_feature: NA.47.87.H10.1.454.light.4.zerom50-aa
MAWTVLLLGLLSHCTGSVTSDELIQAPSMSVAPGQTARITCAGASVGERSVHWYQQMPGQAPVLVVYDDSDRPSGIPERFSGSKSGNTATLTVSRVDVGDEAVYFCQVWETNFGHMLFGGGTKLTVLGQPKAAPSVTLFPPS

SEQ ID NO: 795386 - protein, 140 aa, Homo sapiens
  misc_feature: NA.22.27.C05.1.454.light.4.zerom50-aa
MVLQTQVFISLLLWISGASGDIVMTQSPDSLAVSLGERATINCKSSQSIFYSSTNKSYLAWFQQKPGHPPLLLIYWASTRESGVPDRFSGSGSGTDFTLTISSLQAEDVAVYYCQQYYIPPQTFGQGTKVEIKRTVAAPI

SEQ ID NO: 795387 - protein, 140 aa, Homo sapiens
  misc_feature: NA.14.28.C06.1.454.light.4.zerom50-aa
MDMRVPAQLLGLLLLWLPGARCDIQMTQSPSTLSASVGDRVTITCRASQNINRWLAWYQQKPGKAPKVLIYETSTLESGVPSRFSGSGSGTEFTLTITSLQPDDFATYYCQQYHHHCNFGGGTKVEVKRTVAAPSVFYLP

SEQ ID NO: 795388 - protein, 135 aa, Homo sapiens
  misc_feature: NA.15.71.G05.1.454.light.4.zerom50-aa
PSNTLPAQLLGLLLLWFPGSRCDIQMSQSPSSVSASVGDRVTITCRASQGISSWLAWYQQKPGKAPKLLIYGASSLESGVPPRFSGSESGTDFTLTISSLQPEDFATYYCQQANSFPLTFGGGTKVDIKRTVAAP

SEQ ID NO: 795389 - protein, 134 aa, Homo sapiens
  misc_feature: NA.52.40.D07.1.454.light.4.zerom50-aa
MDMRVPAQLLGLLLLWLPGARCDIQLTQSPSFLSASVGDRVTITCRASQGISSWLAWYQQKPGKAPKLLIYAASTLQSGVPSRFSGSGSGRQFTLTISSLQPEDFATYYCQQLNRYPLFGPGTKVDIKRTVAAP

SEQ ID NO: 795390 - protein, 136 aa, Homo sapiens
  misc_feature: NA.3.40.D07.1.454.light.4.zerom50-aa
MDMRVPAQLLGLLLLWLPGARCDIQMTQSPSTLSASIGDRVTITCGASQSISNLLAWYQQKPGKAPKLLISDASTLHVGVPPTFSGSGSGTDFTLTISSLQPDDVATYYCQQYNTYWTFGQGTKVEIKRTVAAPSV

SEQ ID NO: 795391 - protein, 140 aa, Homo sapiens
  misc_feature: NA.47.66.F11.1.454.light.4.zerom50-aa
MEAPAQLLFLLLLWLPEIAGDILLTQAPVTLSLSPGERATLSCRASQSIGNNLAWYQQKPGQAPRLLIYDASNRATGVPGRFRGGGSGTDFTLTIDGLEPEDFAVYYCQQRNNWPITFGQGTRLEIKRTVAAPSVFIFPP

SEQ ID NO: 795392 - protein, 138 aa, Homo sapiens
  misc_feature: NA.21.4.A04.1.454.light.4.zerom50-aa
METPAQLLFLLLLWLPGSETTGEIVLTQSPGTLSLSPGERATLSCSSSQNIQSYYIAWYQQKPGQAPRFLIYAGSHRATGIPDRFSGSGSGTDFTLIISRLEPEDFAVYYCQQYGSSPLSFGQGTKVEMKRTVAAPSV

SEQ ID NO: 795393 - protein, 146 aa, Homo sapiens
  misc_feature: NA.17.75.G09.1.454.light.4.zerom50-aa
MAWTPLFLFLLTCCPGSNSQAVVTQEPSLSVSPGGTVILTCASSTGEVTSGHYPYWFQVKSGQAPRTLIYDATNRHSWAPGRFSGSLLGGKAALTLTGAQPEDEADYYCLLSFDGGRLPIFGGGTRVAVLGQPKAAPSVTLFPPSS

SEQ ID NO: 795394 - protein, 139 aa, Homo sapiens
  misc_feature: NA.10.63.F08.1.454.light.4.zerom50-aa
MEAPAQLLFLLLLWLPETTAEIVLTQSPATLSLSPGERATLSCRASQSVSRYLAWYQQKPGQAPRLLMYDASNRATGIPARFSGSGSATDFTLTINSLEPEDFALYFCHQSRNWPPTFGQGTKVEIRRTVAAPSVFIFP

SEQ ID NO: 795395 - protein, 136 aa, Homo sapiens
  misc_feature: NA.52.31.C09.1.454.light.4.zerom50-aa
MAWTPLLLPLLTFCTVSEASYELTQPPSVSVSPGQTARITCSGDALPKKYAYWYQQRSGQAPILIIYEDSKRPAGIPQRFSGSSSGTMATLTITGAQVEDEAAFYCFSTDSSGNHRVFGGGTRLTVLGQPKARPLG

SEQ ID NO: 795396 - protein, 139 aa, Homo sapiens
  misc_feature: NA.8.16.B05.1.454.light.4.zerom50-aa
  MOD_RES (139)..(139): Any amino acid
MEAPAQLLFLLLLWLPEIIGEVVMTQSPVTLSVFPGERATLSCAASQSVRTNLAWYQQRPGQAPRLLIFGAFNRASGIPARFSGSGSGTSFTLTINNLQSDDFAVYFCQQSEDWPFTFGGGTKVDLKRTVAAPSVFIFX

SEQ ID NO: 795397 - protein, 142 aa, Homo sapiens
  misc_feature: NA.13.64.F09.1.454.light.4.zerom50-aa
MDMRVPAQLLGLLLLWLRGARCDTQLTQSPVFLSASVGDRVDITCRASQNIKTYLNWYQQTPGKAPKLLIFGSSRLQSGVPSRFSGSGSGTDFTLTIGSLQRDDFATYYCQQTYSTPHSFGQGTKVEVKGTVAAPSVFIFPP

SEQ ID NO: 795398 - protein, 137 aa, Homo sapiens
  misc_feature: NA.4.5.A05.1.454.light.4.zerom50-aa
MEAPAQLLFLLLLWLPDTTGEIVMTQSPATLSVSPGERATLSCRASQSVDGNLAWYQQKPGQAPRLLIYGPSTRATGVPPRFSGSGSGTEFTLTISSLQSEDFALYFCQQYNNWPPSSSFGQGTKLEIKRTVAAPSV

SEQ ID NO: 795399 - protein, 137 aa, Homo sapiens
  misc_feature: NA.10.2.A02.1.454.light.4.zerom50-aa
  MOD_RES (137)..(137): Any amino acid
MEAPAQLLFLLLLWLPDTTGEVVMTQSPATLSVSPGETATLSCRASQSVGSRLAWYQQKRGQAPRLLVYGASTRATGISGRFRGSGSGTEFTVTISSLQSEDFAVYYCQQYNSWPATFGQGTEVEFKRTVAAPSVFX

SEQ ID NO: 795400 - protein, 143 aa, Homo sapiens
  misc_feature: NA.14.78.H01.1.454.light.4.zerom50-aa
MAWALLLLTLLTQDTGSWAQSALTQPASVSGSPGQSITISCTATNGEIGTYNLVSWYQQHPDKAPKLIIYETTKRPSGVSDRFSASKSGHTASLTISGLQTEDEGDYYCCSYGGTRTLLFGGGTKLTVLSQPKARPLGHSVPP

SEQ ID NO: 795401 - protein, 140 aa, Homo sapiens
  misc_feature: NA.4.2.A02.1.454.light.4.zerom50-aa
MDMRVPAQLLGLLLLWLRDARCDTQMTQSPSSLSASVGDRVIISCRASQSVSIYLNWYQFKPGKAPKLLIYAASSLQSGVPSRFSGSGSGTDFTLTISSLQPEDFATYYCQQSYDTPPLTFGGGTKVEIKRTVAAPSVFY

SEQ ID NO: 795402 - protein, 134 aa, Homo sapiens
  misc_feature: NA.12.8.A08.1.454.light.4.zerom50-aa
MAWIPLFLGVLAYCTESMASYELTQPPSMSVSPGQTASITCSGDVLTNEYASWYQQKAGQPPVLLIFQNTRRPSGVPERFSGSDSGNTVTLTISGTQAIDEAVYYCQAWDSSVVFGGGTSLTVLGQPKAAPSVY

SEQ ID NO: 795403 - protein, 140 aa, Homo sapiens
  misc_feature: NA.51.19.B08.1.454.light.4.zerom50-aa
MAWALLLLTLLTQDTGSWAQSALTQPASVSGSPGQSITISCTGTSRDIGTYHLVSWYQQHPGKAPKVIIYEASRRASGISSRFSASASGNTASLTISGLQPEDESHYYCSSYADNSFLVFGGGTKLTVLGQPKAAPSVTS

SEQ ID NO: 795404 - protein, 139 aa, Homo sapiens
  misc_feature: NA.13.25.C03.1.454.light.4.zerom50-aa
MAWALLLLTLLTQDTGSWAQSALTQPASVSGSPGQSITISCTGNSSDLGTYRLVSWYQHHPGKAPRVIIYGGNRRPSGISTRFSGSKSGNTASLTISGLQAEDEAAYYCCSYAGSSVVFGGGSKVTVLGQPKAAPSVTS

SEQ ID NO: 795405 - protein, 141 aa, Homo sapiens
  misc_feature: NA.22.20.B09.1.454.light.4.zerom50-aa
METPAQLLFLLLLWLPDITGDVVLTQSPGTLSLSPGERATLSCKASQNVNNRYVAWYQQRPGQSPVLLVFGAADRATGIPDRFSGSGSGSDYLLTIGGLEPEDSALYYCQLYVNSPPSYIFGQGTKLEIKRTVAAPSVFIP

SEQ ID NO: 795406 - protein, 137 aa, Homo sapiens
  misc_feature: NA.49.51.E07.1.454.light.4.zerom50-aa
MDMRVPAQLLGLLLLWLPGARCDIQLTQSPSFLSASVGDRVTITCRASQGVSSYLAWYQQKPGKAPNLLIYAATTLQSGVPSRFSGSGSGTEFTLTISSLQPEDFATYYCHQVDAYPLTFGGGTKVEIRRTVAAPSS

SEQ ID NO: 795407 - protein, 143 aa, Homo sapiens
  misc_feature: NA.19.5.A05.1.454.light.4.zerom50-aa
MVLQTQVFISLLLWISGAFGDIVLTQSPDTLAVSLGERATINCRSSESILYRPNSKNYLAWYQQKPGQPPKLLIYWASTREIGVPVRFSGSVSGTDFTLTISSLQAEDVAVYYCQQYYESPGTFGPGTKVEIRRTVAAPSVFY

SEQ ID NO: 795408 - protein, 137 aa, Homo sapiens
  misc_feature: NA.43.18.B07.1.454.light.4.zerom50-aa
MAWIPLLLPLLTLCTGSEAAYEVTQPHSVSVSPGQTARITCSGDELPRQFVYWYQQKPAQAPVLVMYKDSERPSGIPERFSGASSGTVVTLTISGVQAEDEADYYCQAVDSSGPYRVFGGGPRLTVLGQPKACPLGL

SEQ ID NO: 795409 - protein, 136 aa, Homo sapiens
  misc_feature: NA.16.2.A02.1.454.light.4.zerom50-aa
MEAPAQLLFLLLLWLPDTTGEIVLTQSPATLSLSPGERATLSCRASQSVSSFLAWYQQRPGQAPRLLIYDASNRATGIPARFSGSGSGTDFTLTISSLEPEDSAIYYCQQSNNWPPLTFGGGTKVEIERTVAAPSV

SEQ ID NO: 795410 - protein, 135 aa, Homo sapiens
  misc_feature: NA.51.3.A03.1.454.light.4.zerom50-aa
MAWIPLLLPLLTLCTGSEASYELTQPPSVSVSSGQTARITCSGDALPKQYAYWYQQKPGQAPVLVIYKDFERPSGTPERFSGSSSATTVTLTISGVQAEDEADYYCQSSDSSGTYVVFGGGTKLTVLGQPKAAPS

SEQ ID NO: 795411 - protein, 150 aa, Homo sapiens
  misc_feature: NA.15.56.F01.1.454.light.4.zerom50-aa
MAWALLLLTLLTQDTGSWAQSALTQPASVSGSPGQSITISCTGTSSDVGTYNLVSWYQHHPGKAPKLMIYEDNERPSGVSNRFSGSKSDNTASLTISGLQAEDEGDYYCCAYRSPTVVLFGGGTKLTVLGQPKAAPSVTLFPPSSLRRLT

SEQ ID NO: 795412 - protein, 139 aa, Homo sapiens
  misc_feature: NA.5.11.A11.1.454.light.4.zerom50-aa
MRLPAQLLGLLMLWVPGSSGDVVMTQSPLSLPVTLGQPASISCRSSQSLVYSDGNTYLNWFQQRPGQSPRRLIYEVSNRDSGVPDRFSGSGSGTDFTLKISTVEAEDVGVYFCMQGTHWPYTFGQGTKLEIKRTVAAPI

SEQ ID NO: 795413 - protein, 136 aa, Homo sapiens
  misc_feature: NA.40.32.C10.1.454.light.4.zerom50-aa
MEAPAQLLFLLLLWLPVITGDIVLTQSPATLSLSPGERATFSCRASQSVSIYLAWYQQRPGQAPRLLIYDASTRATGIPDRFSGSGSGTDFTLTISSLEPEDFGVYYCQQRDSWPAHSFGQGTKLEVKRTVAAPTV

SEQ ID NO: 795414 - protein, 145 aa, Homo sapiens; identical to SEQ ID NO: 795306
  misc_feature: NA.26.11.A11.1.454.light.4.zerom50-aa

SEQ ID NO: 795415 - protein, 137 aa, Homo sapiens
  misc_feature: NA.10.50.E06.1.454.light.4.zerom50-aa
MAWALLFLTLLTQGTGSWAQSALTQPASVSGSPGQSITISCTGTSSDVGGYNYVSWYQQHPGKAPKLIIHDVNNRPSGVSNRFSGFKSGNTASLTISGLQAEDEADYYCSSYTTSSTRVFGGGTKLTVLGQPKACPP

SEQ ID NO: 795416 - protein, 139 aa, Homo sapiens
  misc_feature: NA.9.1.A01.1.454.light.4.zerom50-aa
METPAQLLFLLLLWLPDTTGEIVLTQSPGTLSFSPGERATLSCRTSQSVTSNYLAWYQQKSGQPPRLLIYGESNRATGIPDRFSGSGSGTDFTLTISRLEPEDFAVYYCQQYHRSNTFGQGTRLEIKGTVAAPSVFIFP

SEQ ID NO: 795417 - protein, 137 aa, Homo sapiens
  misc_feature: NA.40.29.C07.1.454.light.4.zerom50-aa
MDMRVPAQLLGLLLLWLPGTKCDIQMTQSPSALSASVGDRVTIICRASQTVNRWLAWYQQKPGKAPSLLISETSILQTGVPARFSGSVSGTDFSLTISSLQPDDSATYWCQQYNSYPYTFGQGTKLEIKRTVAAPSV

SEQ ID NO: 795418 - protein, 141 aa, Homo sapiens
  misc_feature: NA.53.21.B10.1.454.light.4.zerom50-aa
MAWTVLLLGLLSHCTGSVTSYLLTQPPSVSVAPGRTATMTCAGNNIGSKSVHWYQHRPGQAPALVVYDDSDRPSGIPERFSGSNSGDTATLTISRVEAGDEADYYCQVWDFNSDHWVFGGGTKLTVLGQPKARPLGHSVPP

SEQ ID NO: 795419 - protein, 139 aa, Homo sapiens
  misc_feature: NA.43.78.H01.2.454.light.4.zerom50-aa
MRLPAQLLGLLMLWVPGSSGDVVMTQSPLSLPVTLGQPASMTCKSSQSLVHSDGNTYLIWFQQRPGQSPRRLIYKVSDRDSGVPDRFSGSGSGTDFTLKISRVEAEDVGVYYCMQGTHWPVTFGQGTRLEIKRTVAAPI

SEQ ID NO: 795420 - protein, 139 aa, Homo sapiens
  misc_feature: NA.40.70.G04.1.454.light.4.zerom50-aa
MVLQTQVFISLLLWISGAYGDIVMTQSPDSLAVSLGERATINCKSSRSVLYSSNNKNYLAWYQQRPGQPPKLLIYWASTRESGVPDRFSGSGSGTDFTLTISSLQAEDVALYYCQQYFSIPFTFGGGTKVEIKRTVAAP

SEQ ID NO: 795421 - protein, 136 aa, Homo sapiens
  misc_feature: NA.49.79.H02.2.454.light.4.zerom50-aa
MAWALLLLSLLTQGTGSWAQSALTQPRSVSGSPGQSVTISCTGTSSDVGRYNFVSWYQQHPGKAPKLFIYDVTNRPSGVPDRFSASKSGNTASLTISGLQAEDEAHYYCCSYAGNFAFVFGTGTEVTVLGQPKAQP

SEQ ID NO: 795422 - protein, 135 aa, Homo sapiens
  misc_feature: NA.52.70.G04.1.454.light.4.zerom50-aa
METPAQLLFLLLLWLPDITGEIVLTQSPGTLSLSPGERVTLSCRASQSVLASYLAWYQQKPGQAPRLLIYASSSRAAGIPDRFSGSGSGTDFTLTIRRLEPEDFAVYYCQHYDTSLMYTFGQGTKLEIKRTVAAP

SEQ ID NO: 795423 - protein, 133 aa, Homo sapiens
  misc_feature: NA.13.50.E06.2.454.light.4.zerom50-aa
MEAPAQLLFLLLLWLPDTTGEIVLTQSPVTLSVSPGEIATLSCRASQSVSSSLAWYQQKPGQAPRLLIYGASTRATGVPVRFSGSGSGTDFTLTISSLQSEDFAVYYCQQYSYWRTFGQGTRLEIKGTVAAPF

SEQ ID NO: 795424 - protein, 150 aa, Homo sapiens
  misc_feature: NA.49.26.C04.2.454.light.4.zerom50-aa
  MOD_RES (146)..(147): Any amino acid
MAWTPLLLPLLTFCTVSEASYELTQPPSVSVSPGQTARITCSGDALPKKYACWYQKKSGQAPVLLIYDDRKRPSGIPERFSGSTSGTMATLTISGAQVEDEGDYYCYSPDTSENHRGIFGGGTKLTVLGQPKAAPSVTLVPTLLSXXSFP

SEQ ID NO: 795425 - protein, 138 aa, Homo sapiens
  misc_feature: NA.43.44.D11.1.454.light.4.zerom50-aa
MHMRVPAQLLGLLLLWLPGAQCDIQVTQSPSTLSASVGDRVTISCRASQSSVRWLAWYQQKSGQAPRLLMFKASGSESEAPSRFSASGSGTELTLIIRSLQPDDFATYYCQEFDGRLWTFGQGTRVDVKRTVAAPSVF

SEQ ID NO: 795426 - protein, 145 aa, Homo sapiens
  misc_feature: NA.53.41.D08.1.454.light.4.zerom50-aa
  MOD_RES (142)..(142): Any amino acid
MAWTVLLLGLLSHCTGSVTSFVLTQSPSVSVAPGQTARITCGGNNIGRKSVHWYQQMPGQAPVLVVYDDSDRPSGVPERFSGSNSGNTATLTISRVEAGDEADYYCQVWDTSSDHPWVFGGGTRLTVLGQPKAAPSVTLVPXLLS

SEQ ID NO: 795427 - protein, 137 aa, Homo sapiens
  misc_feature: NA.40.61.F06.1.454.light.4.zerom50-aa
MDMRVLAQLLGLLLLCFPGARCDIQMTQSPSSLSASVGDRVTITCRASQDISNYLAWFQQKPGKAPKSLISAASNLQSGVPSRFSGSGSGTNFTLTINSLQTGDFGTYYCQHYNTFPLTFGGGTTVEIRRTVAAPSV

SEQ ID NO: 795428 - protein, 136 aa, Homo sapiens
  misc_feature: NA.43.72.G06.1.454.light.4.zerom50-aa
MAWIPLFLGVLAYCTGSVAAYELTQPPSVSVSPGQTASITCSGDKLGDKYASWYQQKPGESPVLVIYQDDKRPSGIPERFSGSNSGNTATLTISGTQAMDEADFYCQAWDTNTVVFGGGTKLTVLGQPKAAPSVLP

SEQ ID NO: 795429 - protein, 138 aa, Homo sapiens
  misc_feature: NA.41.22.B11.2.454.light.4.zerom50-aa
MDMRVLAQLLGLLLLCFPGARCDIQMTQSPSSLSASVRDRVTITCRASQVISNSLAWFQQKPGKAPKSLIHSASSLQSGVPLKFSGNGFGTHFSLTISSLQPEDCATYYCQQYFTYPWTFGQGTKVEINRTVAAPSVF

SEQ ID NO: 795430 - protein, 144 aa, Homo sapiens
  misc_feature: NA.13.36.D03.4.454.light.4.zerom50-aa
MAWTVLLLGLLSHCTGSVTSYVLTQPPSVSVAPGQTARITCGGNNIGSKSVHWYQQKPGQAPVLVVYVDSDRPSGIPERFSGSNSGNTATLTISRVEAGDEADYYCQVWDSSREHVVFGGGTKLTVLGQPKARPLGHSVPPSST

SEQ ID NO: 795431 - protein, 133 aa, Homo sapiens; identical to SEQ ID NO: 795252
  misc_feature: NA.51.72.G06.1.454.light.4.zerom50-aa

SEQ ID NO: 795432 - protein, 137 aa, Homo sapiens
  misc_feature: NA.52.43.D10.1.454.light.4.zerom50-aa
MEAPAQLLFLLLLWLPDSTEEIVMTQSPATLSVSPGEAVTLSCRASQTVNTNLAWYQHKPGRAPRLLIYGASTRATGVPARFSGSGSGTEFTLTISSLQSEDFAVYYCQQYHNWVLFTFGPGTKVDIKRTVAAPSVF

SEQ ID NO: 795433 - protein, 132 aa, Homo sapiens
  misc_feature: NA.51.24.C02.2.454.light.4.zerom50-aa
MAWIPLFLGVLAYCTGFVASYELIQPPSVSVSPGQTASITCSGDKLRDKYAAWYQQKPGQSPVVVIYQDTKRPSGIPERFSGSTSGNTATLTISGTQAVDEADFYCQAWDSDTAVFGGGTKLTVLGQPKAAP

SEQ ID NO: 795434 - protein, 138 aa, Homo sapiens
  misc_feature: NA.52.25.C03.1.454.light.4.zerom50-aa
MDMRVPAQLLGLLLLWLPGARCDIQLTQSPSFLSASVGDRVTITCRASQGISSYLAWYQQKPGKAPKLLIYGASTLQGGVPSRFSGSGSGTEFTLTISSLQPEDFATYYCQHLNSYSFTFGPGTKVDIKRTVAAPSVF

SEQ ID NO: 795435 - protein, 151 aa, Homo sapiens
  misc_feature: NA.26.72.G06.1.454.light.4.zerom50-aa
MVLQTQVFISLLLWISGARGDIVMTQSPDSLAVSLGERATINCKSSQSVLYRSDNKNYLAWYQQKPGQPPNLLIYWASTRESGVSGRFSASGSGTEFTLTISSLQAEDVAVYYCQQYFRAPYTFGQGTQVEIRRTVAAPSVFIFPKVMKVN

SEQ ID NO: 795436 - protein, 145 aa, Homo sapiens
  misc_feature: NA.48.45.E01.1.454.light.4.zerom50-aa
MAWTVLLLGLLSHCTGSVTSYVLTQPPSVSVAPGKTARITCGGNNIGSKSVHWYQQKPGQAPVLVVFDDTDRPSGIPERFSGSNSVNTATLTISRVEAGDEADYYCQVWDSSSDHPNWVFGGGTKLTVLGQPKARPLGHSRSHPS

SEQ ID NO: 795437 - protein, 137 aa, Homo sapiens
  misc_feature: NA.15.81.H04.1.454.light.4.zerom50-aa
MAWALLLLTLLTQGTGSWAQSALTQPASVSGSPGQSIIIFCTGSSSDVGSYNYVSWYQQYPGKAPKLMIYEVSNRPSGVSNRFSGSKSGNTASLTISGLQAEDEGDYYCSSYRSGSTLVFGGGTKLTVLGQPKAAPS

SEQ ID NO: 795438 - protein, 145 aa, Homo sapiens
  misc_feature: NA.53.6.A06.1.454.light.4.zerom50-aa
MAWTVLLLGLLSHCTGSVTSYVLTQPPSVSVAPGKSARFTCEGRHIETKSVHWYQKKPGQAPVVVVYDDSDRPSGIPERFSGSSSGNTATLTIHRVESGDEADYFCQVWDSLSDQPVFGGGTKLAVLGQPKAAPSVTLFPPSSRT

SEQ ID NO: 795439 - protein, 140 aa, Homo sapiens
  misc_feature: NA.12.12.B01.2.454.light.4.zerom50-aa
MAWTPLLLPLLTFCTVSEASYELTQPPSVSVSPGQTARITCSGAALPIKSPYWYQQKSGQAPVLVIYEDNRRPSGIPERFSGSTSGTMATLTISGAQVEDEADYYCYSTDSTTSHWVFGGGTKLTVLRQPKAAPSVTLFP

SEQ ID NO: 795440 - protein, 137 aa, Homo sapiens
  misc_feature: NA.52.79.H02.1.454.light.4.zerom50-aa
  MOD_RES (111)..(111): Any amino acid
MAWIPLLLPLLTLCTGSEASYELTQPPSVSVSPGQTARITCSGDALPNRYAYWYQQKPGQAPVLVIYKDTERPSGIPERFSGSTSGTMVTLTISGVQAEDEADYYCQSTDXSGTYVFGTGTKVTVLGQPKANPTVTL

SEQ ID NO: 795441 - protein, 148 aa, Homo sapiens
  misc_feature: NA.43.45.E01.1.454.light.4.zerom50-aa
MAWTVLLLGLLSHCTGSVTSYELTQPPSVSVAPGQTASITCGGYNFAQKNVHWYQQKAGQAPVMVVCDDRDRPSGILERFSGSKSGNTATLTISRVEAGDEADYYCQLWDGTGDRYWVFGGGTKLTVLGQPKAAPSVTLFPPSSLLIT

SEQ ID NO: 795442 - protein, 142 aa, Homo sapiens
  misc_feature: NA.48.76.G10.1.454.light.4.zerom50-aa
MDMRVPAQLLGLLLLWLPGAKCDIQMTQFPSTLSTFVGDRVSISCRASQSITRWLAWYQQRPGKAPKLLIQEASTLEVGVPSRFSGSGSGTAFTLTISGLQSDDFATYYCQQYSTYPYTFGQGTKLEIKRTVAAPSVFIFPP

SEQ ID NO: 795443 - protein, 141 aa, Homo sapiens
  misc_feature: NA.48.21.B10.1.454.light.4.zerom50-aa
METPAQLLFLLLLWLPDTTGEIVLTQSPGTLSLSPGESATLSCRASQNVKSHSLAWYQQKPGQPPRLLIYGASTRATGIPDRFSGSGSGTDFTLTITRLEPDDFAVFFCQQYGSSPRTFGQGTKVEIKRTVAAPSVFIFPP

SEQ ID NO: 795444 - protein, 137 aa, Homo sapiens; identical to SEQ ID NO: 795159
  misc_feature: NA.52.68.G02.2.454.light.4.zerom50-aa

SEQ ID NO: 795445 - protein, 145 aa, Homo sapiens
  misc_feature: NA.52.41.D08.4.454.light.4.multim50-aa
  MOD_RES (125)..(125): Any amino acid
MAWALLFLTLLTQGTGSWAQSALTQPASVSGSPGQSITISCTGTSNDIGTYNSVSWYQQYPGKVPKLMIFEVSDRPAGVSHRFSGSKSGSTASLTISGLQAEDEADYYCSSYTNRNTWVFGGGTXLTVLRQPKAAPSVTLFPPSS

SEQ ID NO: 795446 - protein, 139 aa, Homo sapiens
  misc_feature: NA.48.67.G01.1.454.light.4.multim50-aa
MEAPAQLLFLLLLWLPAATGEIVLTQSPATLSLSPGQRASLSCRASQHVSTYLAWYQQKPGQAPRLLIYDASTRATGVPARFSASGSGTDFTLTISSLEPEDFAVYYCQQRANWPLTFGGGTKVDIKRTVAAPSVFIFP

SEQ ID NO: 795447 - protein, 141 aa, Homo sapiens
  misc_feature: NA.48.67.G01.2.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKARPPEPNGPS

SEQ ID NO: 795448 - protein, 137 aa, Homo sapiens
  misc_feature: NA.48.57.F02.2.454.light.4.multim50-aa
MAWALLLFILLTQDTGSWAQSALTQPASMSGSPRQSITVSCTGTSSDVGRYDLVSWYQQHPGKAPKLLIYEITKRPSGVSNRFSGSKSGNTASLTISGLQAEDEADYYCCSYAGGTTWVFGRGTKLTVLGQPKARPP

SEQ ID NO: 795449 - protein, 142 aa, Homo sapiens
  misc_feature: NA.48.57.F02.6.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLVPAL

SEQ ID NO: 795450 - protein, 139 aa, Homo sapiens; identical to SEQ ID NO: 795446
  misc_feature: NA.48.57.F02.7.454.light.4.multim50-aa

SEQ ID NO: 795451 - protein, 143 aa, Homo sapiens
  misc_feature: NA.40.81.H04.2.454.light.4.multim50-aa
MAWALLLLTLLTQGTGSWAQSALTQPPSASGSPGQSVTISCTGTSSDVGGYNYVSWYQLHPGKAPKLMISDVSKRPSGVPDRFSGSKSGNTASLTVSGLQAEDEADYYCYSYAGGNNWVFGGGTKLTVLGQPKARPLGHSRSP

SEQ ID NO: 795452 - protein, 142 aa, Homo sapiens
  misc_feature: NA.49.87.H10.1.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTLFP

SEQ ID NO: 795453 - protein, 135 aa, Homo sapiens
  misc_feature: NA.49.87.H10.2.454.light.4.multim50-aa
MEAPAQLLFLLLLWLPDTTGESVLSQSPATLSLSPGERATLSCRATQSVSTYLAWYQQRPGQPPRLLIYDTSNRATGIPARFSGSGSGTDFTLTISSLEPEDFAVYYCQQRYNWPPMYTFGQGTKLEIRRTVAAP

SEQ ID NO: 795454 - protein, 144 aa, Homo sapiens
  misc_feature: NA.48.30.C08.4.454.light.4.multim50-aa
  MOD_RES (135)..(135): Any amino acid
  MOD_RES (143)..(143): Any amino acid
MAWTVLLLGLLSHCTGSVTSYVLTQPPSVSVAPGKTARITCGGNNIGSKSVHWYQQKPGQAPVLVVFDDTDRPSGIPERFSGSNSVNTATLTISRVEAGDEADYYCQVWDSSSDHPNWVFGGGTKLTVLGQPKAXPLGHSRSXP

SEQ ID NO: 795455 - protein, 134 aa, Homo sapiens
  misc_feature: NA.48.30.C08.5.454.light.4.multim50-aa
MEAPAQLLFLLLLWLPDTTGEVLMTQSPATLSVSPGERATLSCRASQSVSSNLAWYQQKPGQAPRLIIYGASTRATGCPARFSGSGSGTEFSLTISSLQSEDFAVYYCQQYDNWPPFTFGGGTKVEIKRTVAAP

SEQ ID NO: 795456 - protein, 144 aa, Homo sapiens
  misc_feature: NA.43.59.F04.3.454.light.4.multim50-aa
MAWTPLFLFLLTCCPGSSSQTVVTQEPSLTVSPGGTVTLTCALVAGPVTSAYHPNWFQQKPGQGPTALIYGATNKHSWTPARFSGSLLGGKAALTLSGVQPEDEADYYCLLIYGGAWVFGGGTKLTVLGQPKARPLGHSVPTLP

SEQ ID NO: 795457 - protein, 142 aa, Homo sapiens
  misc_feature: NA.43.59.F04.1.454.light.4.multim50-aa
MAWALLFLTLLTQGTGSWAQSALTQPASVSGSPGQSITISCTGSSSDVGTYDHVSWYQQYPGKAPKLLIYDVTYRPSGVSYRFSGSKSGNTASLTISGLQAEDEADYYCNSLTTTDTCVFGGGTKLTVLGQPKAAPSVTLFP

SEQ ID NO: 795458 - protein, 137 aa, Homo sapiens
  misc_feature: NA.43.87.H10.2.454.light.4.multim50-aa
MAWALLLLTLLAQDTGSWAQSALTQPASVSGSPGQSITISCTGTSSDVGSYSLVSWYQVHPGKAPKLMIYEGTKRPSGVSDRFSGSKSGNTASLTISGLQAEDEADYYCCSYAGSYTYVFGIGTTVTVLGQPKAQPL

SEQ ID NO: 795459 - protein, 145 aa, Homo sapiens
  misc_feature: NA.48.24.C02.1.454.light.4.multim50-aa
MAWTVLLLGLLSHCTGSVTSYVLTQPPSVSVAPGKTARITCGGNNIGSKSVHWYQQKPGQAPVLVVFDDTDRPSGIPERFSGSNSVNTATLTISRVEAGDEADYYCQVWDSSSDHPNWVFGGGTKLTVLGQPKAAPSVTLFPPSS

SEQ ID NO: 795460 - protein, 139 aa, Homo sapiens
  misc_feature: NA.48.24.C02.2.454.light.4.multim50-aa
MLPSQLIGFLLLWVPASRGEIVLTQSPDFQSVTPKEKVTITCRASQSIRGSLHWYQQKPDQSPKLLIKYASESISGVPSRFSGSGSGTDFTLTINSLEAEDAATYYCHQTFSLRRTFGQGTRLEIKRTVAAPSVFIFPP

SEQ ID NO: 795461 - protein, 139 aa, Homo sapiens
  misc_feature: NA.48.13.B02.1.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCTSYTSSSTLVVFGGGTKLTVLGQPKARPLG

SEQ ID NO: 795462 - protein, 143 aa, Homo sapiens
  misc_feature: NA.48.13.B02.3.454.light.4.multim50-aa
MAWTPLWLTLLTLCIGSVVSSELTQDPAVSVALGQTVRITCQGDSLRKFSGNWYQQKPGQAPVLLIYGENHRPPGIPDRFSGSTSGDTASLTIAGAQAEDEAAYYCNSRDSRGDYFLIFGGGTKLTVLGQPKAAPSVTLFPPS

SEQ ID NO: 795463 - protein, 134 aa, Homo sapiens; identical to SEQ ID NO: 795455
  misc_feature: NA.48.70.G04.5.454.light.4.multim50-aa

SEQ ID NO: 795464 - protein, 148 aa, Homo sapiens
  misc_feature: NA.49.73.G07.7.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTLSPPSSLST

SEQ ID NO: 795465 - protein, 137 aa, Homo sapiens; identical to SEQ ID NO: 795145
  misc_feature: NA.49.33.C11.2.454.light.4.multim50-aa

SEQ ID NO: 795466 - protein, 133 aa, Homo sapiens
  misc_feature: NA.49.33.C11.3.454.light.4.multim50-aa
MAWIPLLLPLLTLCTDSEASYELTQPPSVSVSSGQTASITCSGDALPKQYAYWYQQKPGQAPVLIIYKDFERASGTPERFSGSSSATTVTLTISGVRAEDEADYYCQSSDSSGTSVVFGGGTKLTVLGQPKAP

SEQ ID NO: 795467 - protein, 135 aa, Homo sapiens
  misc_feature: NA.41.33.C11.1.454.light.4.multim50-aa
MEAPAQLLFLLLLWLPDTTAEILMTQSPATLSVSPGERVTLSCRASQSAGSNLAWYQQKPGQAPRLLISGASTRDTGIPARFSGSGSGTEFTLTISTLQSEDYAVYYCLQYKDWPRVTFGPGTKVDFKRTVAAPF

SEQ ID NO: 795468 - protein, 135 aa, Homo sapiens
  misc_feature: NA.41.33.C11.5.454.light.4.multim50-aa
MDMRVPAQLLGLLLLWLPGAKCDIQMTQSPSILSASVGDRVTITCRASQSIAHALAWYQQKPGKAPKFLIYQASNLESGVPSRFSGSGSGTEFTLTISGLQPDDVATYYCQHYDSYPLTFGGGTKVEVKRTVAAP

SEQ ID NO: 795469 - protein, 143 aa, Homo sapiens
  misc_feature: NA.48.62.F07.5.454.light.4.multim50-aa
MAWTVLLLGLLSHCTGSVTSYVLTQPPSVSVAPGKTARITCGGNNIGSKSVHWYQQKPGQAPVLVVFDDTDRPSGIPERFSGSNSVNTATLTISRVEAGDEADYYCQVWDSSSDHPNWVFGGGTKLTVLGQPKAAPSVTLFPP

SEQ ID NO: 795470 - protein, 136 aa, Homo sapiens
  misc_feature: NA.49.61.F06.2.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVF

SEQ ID NO: 795471 - protein, 134 aa, Homo sapiens
  misc_feature: NA.49.30.C08.7.454.light.4.multim50-aa
  MOD_RES (128)..(128): Any amino acid
METPAQLLFLLLLWLPDTTAEIVLTQSPGTLSLSPGERATLSCRASQSVSNSYVAWYQQKPGQSPRLLIYAASSRATGIPDRFSGSGSGTDFSLTISRLEPEDFAVYYCQHGSIRALTFGGGTKVEIXRTVAAP

SEQ ID NO: 795472 - protein, 135 aa, Homo sapiens
  misc_feature: NA.52.53.E09.2.454.light.4.multim50-aa
MAWIPLLLPLLTLCTGSEASYELTQPPSVSVSSGQTARITCSGDALPKQYAYWYQQKPGQAPVLLIYKDFERPSGTPERFSGSSSATTVTLTISGVQAEDEADYYCQSSDSSGTYVVFGGGTKLTVLGQPKAAPS

SEQ ID NO: 795473 - protein, 144 aa, Homo sapiens
  misc_feature: NA.51.33.C11.1.454.light.4.multim50-aa
MRLPAQLLGLLMLWVPGSSGDVVLTQSPLSLPVTLGQPASISCRSSQGLLYSDGNTYLNWFQQRPGQSPRRLIYKVSNRDSGVPDRFSGSGSGTDFTLIIDRVEAEDVGFYYCMQGTHWPGTFGQGTKVESTNETVAAPSVFYS

SEQ ID NO: 795474 - protein, 139 aa, Homo sapiens; identical to SEQ ID NO: 795446
  misc_feature: NA.48.28.C06.6.454.light.4.multim50-aa

SEQ ID NO: 795475 - protein, 139 aa, Homo sapiens
  misc_feature: NA.48.70.G04.2.454.light.4.multim50-aa
MLPSQLIGFLLLWVPASRGEIVLTQSPDFQSVTPKEKVTITCRASQSIRGSLHWYQQKPDQSPKLLIKYASESISGVPSRFSGSGSGTDFTLTINSLEAEDAATYYCHQTFSLRRTFGQGTRLEIKRTVAAPSVFTLPA

SEQ ID NO: 795476 - protein, 143 aa, Homo sapiens
  misc_feature: NA.41.30.C08.1.454.light.4.multim50-aa
MAWALLFLTLLTQGTGSWAQSALTQPASVSGSPGQSITISCSGINSDLGGYNYVSWYQQYPGKPPKVIIYDVGSRPSGVSSRFSGSKSGNTASLTISGLQAEDEADYYCSSYTSSSTGVFGTGTRVTVLGQPKAQPHCHSRSP

SEQ ID NO: 795477 - protein, 148 aa, Homo sapiens
  misc_feature: NA.51.85.H08.1.454.light.4.multim50-aa
MASFPLLLTLLTHCAGSWAQSVLTQPPSASGTPGRRVAISCSGSSSNIGSNAVNWYQQLPGSAPRLLIFNNDQRASGVPDRFSASKSGTSASLAISGLQSEDEADYYCAAWDDSLYMSLFGGGTQLTVLGQPKARPLGHSRSHPPLVA

SEQ ID NO: 795478 - protein, 137 aa, Homo sapiens
  misc_feature: NA.4.39.D06.1.454.light.4.multim50-aa
MAWALLLLTLLTQGTGSWAQSALTQPPSASGSPGQSVTISCTGTSSDVGRYNYVSWYQQHPGKAPKFIIYEVTKRPSGVPDRFSASKAGNTASLTVSGLQAEDEADYYCSSYAGSYNVIFGGGTKLTVLGQPKAAPS

SEQ ID NO: 795479 - protein, 135 aa, Homo sapiens
  misc_feature: NA.51.53.E09.4.454.light.4.multim50-aa
MAWIPLFLGVLAYCTGFVASYELTQPPSVSVSPGQTASVTCSGDKLRDRYVSWYQQKPGQSPVVVIYQDTKRPSGIPERFSGSNSGNTATLTISGTQAVDEADFYCQAWDSDTAVFGGGPKLTVLGQPKARPLGP

SEQ ID NO: 795480 - protein, 144 aa, Homo sapiens
  misc_feature: NA.49.6.A06.1.454.light.4.multim50-aa
  MOD_RES (139)..(139): Any amino acid
MAWALLLLTLLTQGTGSWAQSALTQPPSASGSPGQSVTISCTGTSSDVGDYNYVSWYQQYPGKAPRLMIYAVSKRPSGVPDRFSGSKSGNTASLTVSGLRAEDEADYFCSSYAGSNNFVIFGGGTKLTVLGQPKAAPSXTLFPP

SEQ ID NO: 795481 - protein, 148 aa, Homo sapiens
  misc_feature: NA.49.83.H06.3.454.light.4.multim50-aa
MDMRVPAQLLGLLLLWLPGAKCDIQMTQSPSTLSASVGDRVTITCRASQNINKWLAWYQQIPGKAPKLLIYEASSLESGVPSRFSGSGSGTEFTLTINSLQPDDFATYYCQHYNHYSPATFGPGTRLDIGRTVAAPSVFIFPPSDLST

SEQ ID NO: 795482 - protein, 136 aa, Homo sapiens
  misc_feature: NA.51.30.C08.1.454.light.4.multim50-aa
MEAPAQLLFLLLLWLPDTTGEIVMTQSPATLSVSPGERATLSCRASQSVNNNLAWYQQKPGQAPRLLIFGSSIRATGVPEKFSGGGSDTEYTLTISTLQSEDVAVYYCQQYSDRPPWTFGQGTKVEMKGTVAAPSV

SEQ ID NO: 795483 - protein, 138 aa, Homo sapiens
  misc_feature: NA.51.30.C08.5.454.light.4.multim50-aa
MAWIPLFLGVLAYCTGFVASYELIQPPSVSVSPGQTASITCSGDKLRDKYAAWYQQKPGQSPVVVIYQDTKRPSGIPERFSGSTSGNTATLTISGTQAVDEADFYCQAWDSDTAVFGGGTKLTVLGQPKASASRTDVP

SEQ ID NO: 795484 - protein, 134 aa, Homo sapiens; identical to SEQ ID NO: 795455
  misc_feature: NA.48.61.F06.5.454.light.4.multim50-aa

SEQ ID NO: 795485 - protein, 147 aa, Homo sapiens
  misc_feature: NA.52.29.C07.2.454.light.4.multim50-aa
  MOD_RES (64)..(64): Any amino acid
MAWALLFLTLLTQGTGSWAQSALTQPASVSGSPGQSITISCTGTRNDIGTYNSVSWYQQYPGKXPKLMIFEVSDRPAGVSHRFSGSKSGSTASLTISGLQAEDEADYYCSSYTNRNTWVFGGGTKLTVLRQPKAAPSVTLFPALLYT

SEQ ID NO: 795486 - protein, 139 aa, Homo sapiens; identical to SEQ ID NO: 795446
  misc_feature: NA.48.78.H01.1.454.light.4.multim50-aa

SEQ ID NO: 795487 - protein, 138 aa, Homo sapiens
  misc_feature: NA.48.78.H01.3.454.light.4.multim50-aa
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKARPLG

SEQ ID NO: 795488 - protein, 135 aa, Homo sapiens
  misc_feature: NA.48.78.H01.4.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKARPL

SEQ ID NO: 795489 - protein, 139 aa, Homo sapiens
  misc_feature: NA.52.28.C06.4.454.light.4.multim50-aa
MEAPAQLLFLLLLWLPDTTGEIVLTQSPATLSLSPGERATLSCRASQSISNYLAWYQQKPGQAPRLLIYDASNRATGIPARFSGGGSGTDFTLTISSLEPEDFAVYYCQQRSNWPPITFGQGTRLEIKRTVAAPSVFIP

SEQ ID NO: 795490 - protein, 143 aa, Homo sapiens; identical to SEQ ID NO: 795469
  misc_feature: NA.48.60.F05.7.454.light.4.multim50-aa

SEQ ID NO: 795491 - protein, 146 aa, Homo sapiens
  misc_feature: NA.41.87.H10.1.454.light.4.multim50-aa
MAWALLLLTLLTQGTGSWAQSALTQPPSASGSPGQSVTISCTGTSSNVGGYNYVSWYQQHPGKVPKLIIYEVSKRPSGVPGRFSGSKFGNTASLTVSGLQSEDEADYYCASYAGSNNFRVFGGGTKLTVLGQPKAAPSVTLFPTSS

SEQ ID NO: 795492 - protein, 146 aa, Homo sapiens
  misc_feature: NA.41.87.H10.2.454.light.4.multim50-aa
MAWTVLLLGLLSHCTASVTSYVLTQPPSASVALGQTARITCGANKIGTTNVHWYQQRPGQAPVVVVHDDYDRPSGIPERFSGSNSGNTATLTITGVEAGDEATYYCHVWETGDDPVALFGGGTKLTVLGQPKAAPSVTLVPHPPSN

SEQ ID NO: 795493 - protein, 136 aa, Homo sapiens
  misc_feature: NA.13.10.A10.2.454.light.4.multim50-aa
MAWIPLFLGVLAYCTGSVASNGLTQPPAMSVSPGQTATITCSGYLLRDRYACWYQQKAGQSPTLVIYEDTKRPSGIPERFSGSNSGNTATLTISGTQPMDEADYYCHTWDNDIGWLFGGGTKLTVLGQPKAAPSVY

SEQ ID NO: 795494 - protein, 137 aa, Homo sapiens
  misc_feature: NA.48.33.C11.4.454.light.4.multim50-aa
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKARPL

SEQ ID NO: 795495 - protein, 140 aa, Homo sapiens
  misc_feature: NA.48.33.C11.2.454.light.4.multim50-aa
MAWTPLLLPLLTFCTVSEASYELTQPPSVSVSPGQTARITCSGDALPKKYAYWYQQKSGQAPVLVIFEDNKRPSGIPERFSGSSSGTMATLTINGAQVDDEADYYCSSTDSSGDRGLFGGGTKLTVLSQPKAAPSVTLVP

SEQ ID NO: 795496 - protein, 136 aa, Homo sapiens
  misc_feature: NA.4.27.C05.1.454.light.4.multim50-aa
MAWIPLFLGVLAYCTGCVTSYELTQPPSLSVSPGQTATITCSGNELADKFVCWYQVRPGQSPLLVMYRDRKRPSGIPERFSGSNSGNTATLTISGTQLLDEADYFCHTWDMGTAIFGGGTKLTVLGQPKAAPSVTP

SEQ ID NO: 795497 - protein, 148 aa, Homo sapiens
  misc_feature: NA.13.11.A11.1.454.light.4.multim50-aa
  MOD_RES (127)..(127): Any amino acid
MVLQTQVFISLLLWISGAYGDIVISQSPDSLAVSLGERATINCKTSQSVLYSSDNRNYLAWYQQKPGQPPKLLFYWASTRESGVPDRFSGSGSGTDFTLTISSLQAEDVAVYYCQQYYISPPRTFGXGTRVEIKRTVAAPSVFILPAY

SEQ ID NO: 795498 - protein, 141 aa, Homo sapiens
  misc_feature: NA.48.37.D04.3.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLFPP

SEQ ID NO: 795499 - protein, 135 aa, Homo sapiens
  misc_feature: NA.48.37.D04.7.454.light.4.multim50-aa
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKAP

SEQ ID NO: 795500 - protein, 144 aa, Homo sapiens
  misc_feature: NA.52.87.H10.4.454.light.4.multim50-aa
MAWTALLLSLLAHFTGSAASHDLTQSLSVSVALGQTATITCGGYNIGTKNVQWYQQKPGQAPVLVIYRDRRRASGIPERFSGSNSENTATLTIRSAQVGDEADYYCQVWDSGVVIFGGGTKLTVLSQPKAAPSVTLVPTLLYTI

SEQ ID NO: 795501 - protein, 140 aa, Homo sapiens
  misc_feature: NA.49.30.C08.4.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFYLPA

SEQ ID NO: 795502 - protein, 141 aa, Homo sapiens
  misc_feature: NA.48.53.E09.3.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLVPP

SEQ ID NO: 795503 - protein, 141 aa, Homo sapiens
  misc_feature: NA.48.53.E09.7.454.light.4.multim50-aa
MAGFPLLLTLLTHCAGSWAQSVLTQPPSTSGTPGQTVTISCSGSRWNIGSNFVHWYQQLPGAAPKLLIYRNDKRPSGVPARFSGSKSGTTASLAIRGLRSEDEGDFYCAVWDDDMNGSIFGGGTKLTVLGQPKAAPSVHSS

SEQ ID NO: 795504 - protein, 138 aa, Homo sapiens
  misc_feature: NA.51.33.C11.5.454.light.4.multim50-aa
MEAPAQLLFLLLLWLPDSTGEIVLTQSPGTLSLSPGERATLSCRASQSVSHFLAWYQHKPGQAPRLLIYDASKRATGVPARFSGSGSGTDFTLTISSLEPEDFAIYYCQQRSNWPPSITFGQGTRLENKRTVAAPSVF

SEQ ID NO: 795505 - protein, 139 aa, Homo sapiens
  misc_feature: NA.51.33.C11.6.454.light.4.multim50-aa
MAWALLFLTLLTQGTGSWAQSALTQPASVSGSPGQSITISCTGTSGDIGVYNYVSWYQHHPGKAPKLMIYDVSDRPSGVSNRFSGSKSGNTASLTISGLQAEDEADYYCSSYTINNNWVFGGGTKLTVLGQPKARPLGH

SEQ ID NO: 795506 - protein, 136 aa, Homo sapiens; identical to SEQ ID NO: 795470
  misc_feature: NA.49.41.D08.2.454.light.4.multim50-aa

SEQ ID NO: 795507 - protein, 137 aa, Homo sapiens
  misc_feature: NA.48.28.C06.1.454.light.4.multim50-aa
MAWALLLFILLTQDTGSWAQSALTQPASMSGSPRQSITVSCTGTSSDVGRYDLVSWYQQHPGKAPKLLIYEITKRPSGVSNRFSGSKSGNTASLTISGLQAEDEADYYCCSYAGGTTWVFGRGTKLTVLGQPKACPP

SEQ ID NO: 795508 - protein, 134 aa, Homo sapiens
  misc_feature: NA.48.28.C06.3.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKAAP

SEQ ID NO: 795509 - protein, 137 aa, Homo sapiens
  misc_feature: NA.48.28.C06.5.454.light.4.multim50-aa
  MOD_RES (137)..(137): Any amino acid
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKAAPX

SEQ ID NO: 795510 - protein, 141 aa, Homo sapiens
  misc_feature: NA.13.55.E11.1.454.light.4.multim50-aa
MAWTALLLSLLAHFTASVASYELTQPLSVSVAPGQTATIPCEGNNLRSQNVHWYQQKSGQAPVVVIYRDNNRPSGIPDRFSGSNSGNTATLTINRAQDGDEADYYCQVWDSTTVIFGGGTKLTVLGQPKAAPSVTLFPPSS

SEQ ID NO: 795511 - protein, 148 aa, Homo sapiens
  misc_feature: NA.3.33.C11.1.454.light.4.multim50-aa
FAWALLLLTLLTQGTGSWAQSALTQPPSASGSPGQSVTISCTGTSSDIGDYNYVSWYQQHPGKAPKLMIYEVTKRPSGVPDRFSASKSGNTASLTVSGLQPEDEADYYCSSYAGINTVFGGGTKLTVLGQPKAAPSVTLFPPSSSASS

SEQ ID NO: 795512 - protein, 139 aa, Homo sapiens
  misc_feature: NA.49.24.C02.3.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFIFP

SEQ ID NO: 795513 - protein, 138 aa, Homo sapiens
  misc_feature: Description of Unknown: NA.49.24.C02.4.454.light.4.multim50-aa
MDMRVPAQLLGLLLLWLRGARCDIQMTQSPSSLSASVGDRVTIICRASQSISNYLNWYQHTPGKAPRLLIYAAANLQSGVPSRFSGSGSGTEFTLTISSLQPEDFGKYYCQQSYGNLLIFGGGTKVEIKRTVAAPSVF

SEQ ID NO: 795514 - protein, 140 aa, Homo sapiens
  misc_feature: NA.3.37.D04.1.454.light.4.multim50-aa
MAWALLFLTLLTQGTGSWAQSALSQPASVSGSPGQSITISCTGTSSDVGRYNYVSWYQQLPGKAPKLMIYDVNNRPSGVSNRFSGSKSGNTASLTISGLQGEDEADYYCSSFTSSTTQVFGTGTKVTVLGQPKANPTVTP

SEQ ID NO: 795515 - protein, 140 aa, Homo sapiens
  misc_feature: NA.3.37.D04.2.454.light.4.multim50-aa
MRLPAQLLGLLMLWVSGSSGDIVMTQSPLSLAVTPGETASISCRSSESVQGNGYDYLDWYLQKPGQPPQLLIYLASNRASGVPDRFSGSGSGTDFKLIISRVEAEDVGIYYCVQVRQTPFTFGPGTKVDIKRTVAAPSVF

SEQ ID NO: 795516 - protein, 143 aa, Homo sapiens
  misc_feature: NA.48.77.G11.3.454.light.4.multim50-aa
MAWTVLLLGLLSHCTGSVTSYVLTQPPSVSVAPGKTARITCGGTNIGRRSVHWYQQKPGQAPLMIVYDDSDRPSGIPERVAGSNSGNTATLAISRVEAGDEADYYCQVWDNGGDHPNWVFGGGTKLTVLSQPKACPLGHSVPD

SEQ ID NO: 795517 - protein, 149 aa, Homo sapiens
  misc_feature: NA.8.34.D01.1.454.light.4.multim50-aa
MEAPAQLLFLLLLWLPVSDTTGEIVLTQSPATLSSSPGERATLSCRASQNVGAYVSWYQQKPGQAPRPLIYGASNRATGIPARFSGSGYGTDFTLTIISLEPEDVAVYYCQHRTEWPPGATFGPGTKVDIKRTVAAPSVFYLPAICRHA

SEQ ID NO: 795518 - protein, 145 aa, Homo sapiens
  misc_feature: NA.41.35.D02.1.454.light.4.multim50-aa
MAWALLLLTLLTQDTGSWAQSALTQPASVSGSPGQSITISCTGTISDVDYYNLVSWYQQHPGKAPKLLIYEGDQRPSGVSDRFSGSKSGNTASLTVSRLQAEDEADYYCFSYADTKSWVFGGGTKLTVLGQPKAAPSVTLFPPSS

SEQ ID NO: 795519 - protein, 143 aa, Homo sapiens
  misc_feature: NA.41.30.C08.2.454.light.4.multim50-aa
  MOD_RES (59)..(59): Any amino acid
  MOD_RES (110)..(110): Any amino acid
  MOD_RES (116)..(118): Any amino acid
MAWALLFLTLLTQGTGSWAQSALTQPASVSGSPGQSITISCTGTSSDVGGYNYVSWYQXHPGKAPKLIIYEVSKRPSGVSDRFSGSKSGNTASLTVSGLQAEDEADYYCXSYAGSXXXWVFGGGTKLTVLGQPKAAPSVTLFP

SEQ ID NO: 795520 - protein, 135 aa, Homo sapiens; identical to SEQ ID NO: 795468
  misc_feature: NA.41.35.D02.3.454.light.4.multim50-aa

SEQ ID NO: 795521 - protein, 137 aa, Homo sapiens
  misc_feature: NA.49.85.H08.2.454.light.4.multim50-aa
MDMRVPAQLLGLLLLWLSGARCDIRMTQSPSSLSASVGDRITITCQATQDISNYLNWYQQKPGKAPNLLIYDASNLEIGVPSRFSGSGSGTYFTFTIINLQPEDIATYYCQQYDNLPLTFGGGTTVEIKRTVAAPSV

SEQ ID NO: 795522 - protein, 140 aa, Homo sapiens
  misc_feature: NA.49.85.H08.3.454.light.4.multim50-aa
  MOD_RES (110)..(110): Any amino acid
  MOD_RES (113)..(113): Any amino acid
  MOD_RES (116)..(119): Any amino acid
  MOD_RES (127)..(127): Any amino acid
MAWALLLLTLLTQDTGSWAQSALTQPASVSGSPGQSITISCTETSSDVGNYNLFSWYQQHPGKAPKLIIYEADQRPSGVSDRFSGSTSGSTASLTISGLQAGDEADYYCXSYXGBXXXXVFGGGTKXTVLGQPKARPLGL

SEQ ID NO: 795523 - protein, 139 aa, Homo sapiens
  misc_feature: NA.3.71.G05.1.454.light.4.multim50-aa
MAWTPLWLTLLTLCIGSVVSSELTQDPAVSVALGQTVRITCQGDSLRSYYASWYQQKPGQAPVLVIYGKNNRPSGIPDRFSGSSSGNTASLTITGAQAEDEADYYCNSRASSGNIVIFGGGTKVTVLRQPKAAPSVTLR

SEQ ID NO: 795524 - protein, 137 aa, Homo sapiens
  misc_feature: NA.51.29.C07.1.454.light.4.multim50-aa
MEAPAQLLFLLLLWLPDTTGEIVMTQSPATLSVSPGERATLSCRASQSVNNNLAWYQQKPGQAPRLLIFGSSIRATGVPEKFSGGGSDTEYTLTISTLQSEDVAVYYCQQYSDRPPWTFGQGTKVEMKGTVAAPSVF

SEQ ID NO: 795525 - protein, 139 aa, Homo sapiens
  misc_feature: NA.48.26.C04.2.454.light.4.multim50-aa
MEAPAQLLFLLLLWLPDSTGQIVMTQSPATLSVSPGERVTLSCRASESLDSSLAWYQQRPGQPPRLLIYDTSTRATGVPARFTGGGSGTEFTLTISSLQSEDFTFYYCQQYRKWTPTFGQGTKVEVKRTVAAPSVFIFP

SEQ ID NO: 795526 - protein, 139 aa, Homo sapiens
  misc_feature: NA.48.26.C04.1.454.light.4.multim50-aa
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKARPLGI

SEQ ID NO: 795527 - protein, 144 aa, Homo sapiens; identical to SEQ ID NO: 795093
  misc_feature: NA.40.42.D09.2.454.light.4.multim50-aa

SEQ ID NO: 795528 - protein, 140 aa, Homo sapiens
  misc_feature: NA.48.34.D01.1.454.light.4.multim50-aa
MEAPAQLLFLLLLWLPDSTGQIVMTQSPATLSVSPGERVTLSCRASESLDSSLAWYQQRPGQPPRLLIYDTSTRATGVPARFTGGGSGTEFTLTISSLQSEDFTFYYCQQYRKWTPTFGQGTKVEVKRTVAAPSVFIFPP

SEQ ID NO: 795529 - protein, 135 aa, Homo sapiens
  misc_feature: NA.48.34.D01.3.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKARPP

SEQ ID NO: 795530 - protein, 139 aa, Homo sapiens; identical to SEQ ID NO: 795446
  misc_feature: NA.48.34.D01.6.454.light.4.multim50-aa

SEQ ID NO: 795531 - protein, 144 aa, Homo sapiens
  misc_feature: NA.41.33.C11.2.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVLGQPKARPLGHSRSP

SEQ ID NO: 795532 - protein, 144 aa, Homo sapiens
  misc_feature: NA.41.33.C11.3.454.light.4.multim50-aa
MAWTVLLLGLLSHCTASVTSYVLTQPPSASVALGQTARITCGANKIGTTNVHWYQQRPGQAPVVVVHDDYDRPSGIPERFSGSNSGNTATLTITGVEAGDEATYYCHVWETGDDPVALFGGGTKLTVLGQPKAAPSVTLFPPSS

SEQ ID NO: 795533 - protein, 135 aa, Homo sapiens; identical to SEQ ID NO: 795453
  misc_feature: NA.49.34.D01.2.454.light.4.multim50-aa

SEQ ID NO: 795534 - protein, 133 aa, Homo sapiens; identical to SEQ ID NO: 795466
  misc_feature: NA.49.34.D01.8.454.light.4.multim50-aa

SEQ ID NO: 795535 - protein, 141 aa, Homo sapiens
  misc_feature: NA.8.33.C11.1.454.light.4.multim50-aa
MEAPAQLLFLLLLWLPVSDTTGEIVLTQSPATLSLSPGERATLSCRASQNVGAFVSWYQHKPGQAPRPLIYGASNRATGIPARFSGSGYGTDFTLTIISLEPEDVAVYYCQHRTEWPPGATFGPGTKVEIKRTVAAPSVFY

SEQ ID NO: 795536 - protein, 136 aa, Homo sapiens
  misc_feature: NA.43.37.D04.4.454.light.4.multim50-aa
MAWALLLLTLLAQDTGSWAQSALTQPASVSGSPGQSITISCTGTSSDVGSYSLVSWYQVHPGKAPKLMIYEGTKRPSGVSDRFSGSKSGNTASLTISGLQAEDEADYYCCSYAGSYTYVFGIGTTVTVLGQPKANP

SEQ ID NO: 795537 - protein, 138 aa, Homo sapiens
  misc_feature: NA.43.37.D04.7.454.light.4.multim50-aa
  MOD_RES (12)..(12): Any amino acid
  MOD_RES (14)..(14): Any amino acid
  MOD_RES (27)..(27): Any amino acid
  MOD_RES (29)..(29): Any amino acid
  MOD_RES (37)..(37): Any amino acid
MAWALLLLTLLXQXTGSWAQSALTQPXSXSGSPGQSXTISCTGSSSDIGGYTYVSWYQQHPGKAPKLMIYEVNKRPSGVPDRFSGSKSGNTATLTVSGLQAEDEAHYYCSSYTGNKNLVFGGGTELTVLGQPKARPLG

SEQ ID NO: 795538 - protein, 140 aa, Homo sapiens
  misc_feature: NA.49.78.H01.2.454.light.4.multim50-aa
MEAPAQLLFLLLLWLPDTTGESVLSQSPATLSLSPGERATLSCRATQSVSTYLAWYQQRPGQPPRLLIYDTSNRATGIPARFSGSGSGTDFTLTISSLEPEDFAVYYCQQRYNWPPMYTFGQGTKLEIRRTVAAPSVFIP

SEQ ID NO: 795539 - protein, 145 aa, Homo sapiens
  misc_feature: NA.40.35.D02.3.454.light.4.multim50-aa
MAGFPLLLTLLTHCAGSWAQSVLTQPPSASGTPGQRVTISCSGSNSNIGTNYVYWYQQLPGTAPKVLFYRNNQRPSGVPDRFSASKSGTSVSLAISGLRSEDEGDYYCAAWDESLRGWLFGGGTKLTVLGQPKARPLGHSRSHPP

SEQ ID NO: 795540 - protein, 135 aa, Homo sapiens; identical to SEQ ID NO: 795453
  misc_feature: NA.49.38.D05.3.454.light.4.multim50-aa

SEQ ID NO: 795541 - protein, 143 aa, Homo sapiens
  misc_feature: NA.48.42.D09.1.454.light.4.multim50-aa
  MOD_RES (49)..(49): Any amino acid
  MOD_RES (80)..(81): Any amino acid
  MOD_RES (86)..(86): Any amino acid
  MOD_RES (92)..(92): Any amino acid
  MOD_RES (111)..(113): Any amino acid
  MOD_RES (130)..(130): Any amino acid
MAWTVLLLGLLSHCTGSVTSYVLTQPPSVSVAPGKTARITCGGNNIGSXSVHWYQQKPGQAPVLVVFDDTDRPSGIPERXXGSNSXNTATLXISRVEAGDEADYYCQVWDXXXDHPNWVFGGGTKLTVLXQPKAAPSVTLFPT

SEQ ID NO: 795542 - protein, 138 aa, Homo sapiens
  misc_feature: NA.48.42.D09.5.454.light.4.multim50-aa
MLPSQLIGFLLLWVPASRGEIVLTQSPDFQSVTPKEKVTITCRASQSIRGSLHWYQQKPDQSPKLLIKYASESISGVPSRFSGSGSGTDFTLTINSLEAEDAATYYCHQTFSLRRTFGQGTRLEIKRTVAAPSVFIFP

SEQ ID NO: 795543 - protein, 138 aa, Homo sapiens
  misc_feature: NA.5.12.B01.1.454.light.4.multim50-aa
  MOD_RES (137)..(137): Any amino acid
MAWALLFLTLLTQGTGSWAQSALTQPASVSGSPGQSITISCTGTNSDIGAYDYVSWYQKYPDTAPKLILYDVRVRPSGVSVRFSGSKSGSTASLTISGLQAEDEADYYCSSYGSMKTLVIFGGGTKLTVLSQPKAPXP

SEQ ID NO: 795544 - protein, 139 aa, Homo sapiens
  misc_feature: NA.51.35.D02.2.454.light.4.multim50-aa
MEAPAQLLFLLLLWLPDSTGEIVLTQSPGTLSLSPGERATLSCRASQSVSHFLAWYQHKPGQAPRLLIYDASKRATGVPARFSGSGSGTDFTLTISSLEPEDFAIYYCQQRSNWPPSITFGQGTRLENKRTVAAPSVFY

SEQ ID NO: 795545 - protein, 134 aa, Homo sapiens
  misc_feature: NA.51.35.D02.5.454.light.4.multim50-aa
MAWIPLFLGVLAYCTGFVASYELTQPPSVSVSPGQTASVTCSGDKLRDRYVSWYQQKPGQSPVVVIYQDTKRPSGIPERFSGSNSGNTATLTISGTQAVDEADFYCQAWDSDTAVFGGGPKLTVLGQPKAAPSG

SEQ ID NO: 795546 - protein, 141 aa, Homo sapiens
  misc_feature: NA.51.87.H10.1.454.light.4.multim50-aa
MAWALLFLTLLTQGTGSWAQSALTQPASVSGSPGQSITISCTGTTNDIGTYNSVSWYQQYPGKVPKLMIFEVSDRPAGVSHRFSGSKSGSTASLTISGLQAEDEADYYCSSYTNRNTWVFGGGTKLTVLRQPKARPLGHSV

SEQ ID NO: 795547 - protein, 140 aa, Homo sapiens
  misc_feature: NA.51.87.H10.2.454.light.4.multim50-aa
MDMRVPAQLLGLLLLWLPGAKCDIQMTQSPSTLSASVGDRVSITCRATENIHNWLAWYQQKPGKAPKLLIYKTSNLEGGVPSRFSGGGSGTEFTLTITSLQPDDFATYYCQQYYSYWTFGQGTKVEIKRTVAAPSVFIFP

SEQ ID NO: 795548 - protein, 139 aa, Homo sapiens; identical to SEQ ID NO: 795544
  misc_feature: NA.51.87.H10.6.454.light.4.multim50-aa

SEQ ID NO: 795549 - protein, 138 aa, Homo sapiens
  misc_feature: NA.51.41.D08.1.454.light.4.multim50-aa
MDMRVPAQLLGLLLLWLRGARCDIQMTQSPSSLSASVGDRVTITCRASQSISSYLNWYQQKPGKAPKLLIYAASSLQSEVPSRFSGSGSGTDFTLTISSLQPEDFATYYCQQSYGTLLTFGGGTKVEIKRTVAAPICL

SEQ ID NO: 795550 - protein, 146 aa, Homo sapiens
  misc_feature: NA.51.41.D08.6.454.light.4.multim50-aa
MEAPAQLLFLLLLWLPDTTGEIVMTQSPATLSVSPGERATLSCRASQSVNNNLAWYQQKPGQAPRLLIFGSSIRATGVPEKFSGGGSDTEYTLTISTLQSEDVAVYYCQQYSDRPPWTFGQGTKVEMKGTVAAPSVFIFPPSDRST

SEQ ID NO: 795551 - protein, 137 aa, Homo sapiens; identical to SEQ ID NO: 795145
  misc_feature: NA.49.27.C05.1.454.light.4.multim50-aa

SEQ ID NO: 795552 - protein, 143 aa, Homo sapiens
  misc_feature: NA.51.57.F02.2.454.light.4.multim50-aa
MAWALLFLTLLTQGTGSWAQSALTQPASVSGSPGQSITISCTGTSGDIGVYNYVSWYQHHPGKAPKLMIYDVSDRPSGVSNRFSGSKSGNTASLTISGLQAEDEADYYCSSYTINNNWVFGGGTKLTVLGQPKAAPSVTLVPP

SEQ ID NO: 795553 - protein, 138 aa, Homo sapiens; identical to SEQ ID NO: 795504
  misc_feature: NA.51.57.F02.4.454.light.4.multim50-aa

SEQ ID NO: 795554 - protein, 138 aa, Homo sapiens
  misc_feature: NA.48.55.E11.2.454.light.4.multim50-aa
METPAQLLFLLLLWLPDTTGALVLTQSPGTLSLSPGERATLSCRASQSVSGGSVAWYQQKRGQVPRLLIYDASSRATGIPDRFSGSGSGTDFTLTISRLEPEDFAVYYCQQYGSSPQLTFGGGTKVEIKRTVAAPYCL

SEQ ID NO: 795555 - protein, 138 aa, Homo sapiens
  misc_feature: NA.48.55.E11.3.454.light.4.multim50-aa
  MOD_RES (138)..(138): Any amino acid
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKARPLX

SEQ ID NO: 795556 - protein, 134 aa, Homo sapiens; identical to SEQ ID NO: 795508
  misc_feature: NA.48.55.E11.5.454.light.4.multim50-aa

SEQ ID NO: 795557 - protein, 135 aa, Homo sapiens
  misc_feature: NA.48.87.H10.1.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKAAPS

SEQ ID NO: 795558 - protein, 136 aa, Homo sapiens
  misc_feature: NA.48.87.H10.2.454.light.4.multim50-aa
MAWALLLLTLLTQGTGSWAQSALTQPPSASGSPGQSVTISCTGTSSDVGGYNYVSWYQQHPGKAPKVMIYEVSKRPSGVPDRFSGSKSGNTASLTVSGLQAEDEADYYCSSYAGSNNVVFGGGTKLTVLGQPKAPP

SEQ ID NO: 795559 - protein, 140 aa, Homo sapiens; identical to SEQ ID NO: 795495
  misc_feature: NA.48.87.H10.5.454.light.4.multim50-aa

SEQ ID NO: 795560 - protein, 139 aa, Homo sapiens; identical to SEQ ID NO: 795446
  misc_feature: NA.48.87.H10.6.454.light.4.multim50-aa

SEQ ID NO: 795561 - protein, 144 aa, Homo sapiens
  misc_feature: NA.17.31.C09.1.454.light.4.multim50-aa
MAWTPLFLFLLTCCPGSNSQAVVTQEPSLTVSPGGTVTLTCGSSTGAVTNGHYPYWFQQKPGQAPRTLIYDTNNKHSWTPARFSGSLVGGKAALTLSGAQPEDEAEYYCLLSYSGVRVFGGGTKLTVLGQPKAAPSVTLFPPSS

SEQ ID NO: 795562 - protein, 144 aa, Homo sapiens
  misc_feature: NA.41.37.D04.1.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVLGQPKAVPPVHSRSP

SEQ ID NO: 795563 - protein, 133 aa, Homo sapiens
  misc_feature: NA.41.37.D04.4.454.light.4.multim50-aa
MEAPAQLLFLLLLWLPDTTGEIVMTQSPDTLSVSPGERATLSCRASQSVTNKLAWYQQKSGQSPRLLIYSADTRATGVPDRFSGSGSGTEFTLSLSSLQSEDFAVYYCQQYHKWPLTFGGGTKVEIKRTVAAP

SEQ ID NO: 795564 - protein, 142 aa, Homo sapiens
  misc_feature: NA.13.71.G05.1.454.light.4.multim50-aa
MAWIPLFLGVLAYCTGSVASYELTQPPSVSVSPGQTASITCSGDKLGDKYACWYQQKPGQSPVLVIYQDTKRPSGIPERFSGSNSGNTATLTISGTQAVDEADYYCQAWDSSTASFGTGTKVTVLGQPKANPTRHSRSPPSL

SEQ ID NO: 795565 - protein, 143 aa, Homo sapiens
  misc_feature: NA.41.37.D04.7.454.light.4.multim50-aa
MEAPAQLLFLLLLWLPDTTGEIVMTQSPDTLSLGLGERATLSCRASETVTVNYLAWYQQKPGQAPRLLISAASYRATGIPDRFSGSGSGTDFTLSISRLEPEDFAIYYCHQYGSSPLTFGGGTKVEIKRTVAAPSVFIFPPSE

SEQ ID NO: 795566 - protein, 136 aa, Homo sapiens
  misc_feature: NA.48.35.D02.2.454.light.4.multim50-aa
MAWALLLFILLTQDTGSWAQSALTQPASMSGSPRQSITVSCTGTSSDVGRYDLVSWYQQHPGKAPKLLIYEITKRPSGVSNRFSGSKSGNTASLTISGLQAEDEADYYCCSYAGGTTWVFGRGTKLTVLGQPKAAP

SEQ ID NO: 795567 - protein, 137 aa, Homo sapiens; identical to SEQ ID NO: 795494
  misc_feature: NA.48.35.D02.4.454.light.4.multim50-aa

SEQ ID NO: 795568 - protein, 139 aa, Homo sapiens; identical to SEQ ID NO: 795446
  misc_feature: NA.48.35.D02.6.454.light.4.multim50-aa

SEQ ID NO: 795569 - protein, 145 aa, Homo sapiens
  misc_feature: NA.43.27.C05.2.454.light.4.multim50-aa
MAWALLLLTLLAQDTGSWAQSALTQPASVSGSPGQSITISCTGTSSDVGSYSLVSWYQVHPGKAPKLMIYEGTKRPSGVSDRFSGSKSGNTASLTISGLQAEDEADYYCCSYAGSYTYVFGIGTTVTVLGQPKANPNGPETPNPL

SEQ ID NO: 795570 - protein, 137 aa, Homo sapiens
  misc_feature: NA.49.58.F03.4.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFY

SEQ ID NO: 795571 - protein, 138 aa, Homo sapiens
  misc_feature: NA.40.57.F02.1.454.light.4.multim50-aa
  MOD_RES (137)..(137): Any amino acid
MAWALLLLSLLTQGTGSWAHSTLTQPRSVSGSPGQSVTISCTGTSSDIGAYNSVSWYQQHPGKGPKLLIYDVTKRPSGVADRFSGSKSGDTASLTISGLQTEDEATYFCCSYAGSFALEVFGGGTELTVLRQPKAPXP

SEQ ID NO: 795572 - protein, 141 aa, Homo sapiens
  misc_feature: NA.43.55.E11.4.454.light.4.multim50-aa
  MOD_RES (130)..(130): Any amino acid
MPWALLLLTLLTHSAVSVVQAGLTQPPSVSKGLRQTATLTCTGNSNNVGNQGAAWLQQHQGHPPKLLSYRNNNRPSGISERLSASRSGNTASLTITGLQPEDEADYYCSAWDSSLSAWVFGGGTKLTVLXQPKASPPRSLS

SEQ ID NO: 795573 - protein, 143 aa, Homo sapiens
  misc_feature: NA.48.23.C01.1.454.light.4.multim50-aa
  MOD_RES (143)..(143): Any amino acid
MASFPLLLTLLTHCAGSWAQSVLTQPPSASGTPGQSVTISCSGSGSNIGRNTVNWYQQLPGAAPRLYIYNNYRRPSGVPDRVSASKSGTSASLAISGLRSEEEGDYYCAAWDDSLNAWVFGGGTKLTVLGQPKARPLGPLCSX

SEQ ID NO: 795574 - protein, 138 aa, Homo sapiens
  misc_feature: NA.48.23.C01.2.454.light.4.multim50-aa
MAWTPLLLPLLTFCTVSEASYELTQPPSVSVSPGQTARITCSGDALPKKYAYWYQQKSGQAPVLVIFEDNKRPSGIPERFSGSSSGTMATLTINGAQVDDEADYYCSSTDSSGDRGLFGGGTKLTVLSQPKAAPSVTL

SEQ ID NO: 795575 - protein, 145 aa, Homo sapiens
  misc_feature: NA.48.23.C01.6.454.light.4.multim50-aa
  MOD_RES (139)..(139): Any amino acid
  MOD_RES (143)..(143): Any amino acid
MAGFPLLLTLLTHCAGSWAQSVLTQPPSTSGTPGQTVTISCSGSRWNIGSNFVHWYQQLPGAAPKLLIYRNDKRPSGVPARFSGSKSGTTASLAIRGLRSEDEGDFYCAVWDDDMNGSIFGGGTKLTVLGQPKAAPSVXSVPXLL

SEQ ID NO: 795576 - protein, 138 aa, Homo sapiens
  misc_feature: NA.41.17.B06.1.454.light.4.multim50-aa
MEAPAQLLFLLLLWLPDITGEIVMTQSPATLSLSPGERASLSCRASQNIRGHLAWYQQKPGQAPRLLIYAASTRATGIPARFSGGGSGTEFTLTINGLQSEDSAVYYCQQYVDWPPLTFGGGTKVEIRRTVAAPILSS

SEQ ID NO: 795577 - protein, 141 aa, Homo sapiens
  misc_feature: NA.51.37.D04.3.454.light.4.multim50-aa
MAWIPLLLPLLTLCTGSEASYELTQPASVSVSPGQTAKIPCSGDALPKRFAFWYQQKPGQAPIIIIYKDSERPSGIPERFSGSSSGTTATLTISGVQAEDEADYYCQSADDSGTYGVFGGGTKVTVLGQPKAAPSVTLVPP

SEQ ID NO: 795578 - protein, 148 aa, Homo sapiens; identical to SEQ ID NO: 795165
  misc_feature: NA.51.37.D04.6.454.light.4.multim50-aa

SEQ ID NO: 795579 - protein, 136 aa, Homo sapiens
  misc_feature: NA.41.34.D01.1.454.light.4.multim50-aa
MDMRVPAQLLGLLLLWLPGAKCDIQMTQSPSILSASVGDRVTITCRASQSIAHALAWYQQKPGKAPKFLIYQASNLESGVPSRFSGSGSGTEFTLTISGLQPDDVATYYCQHYDSYPLTFGGGTKVEVKRTVAAPT

SEQ ID NO: 795580 - protein, 145 aa, Homo sapiens; identical to SEQ ID NO: 795131
  misc_feature: NA.49.9.A09.3.454.light.4.multim50-aa

SEQ ID NO: 795581 - protein, 138 aa, Homo sapiens
  misc_feature: NA.52.35.D02.2.454.light.4.multim50-aa
MEAPAQLLFLLLLWLPDTTGEVVLTQSPATLSLSPGGRATLSCRASQSVGNLLAWYQQKPGQAPRLLIYDASTRATGIPARFSGSGSETDFTLTISGLEPEDFAVYYCQQRSHWLSFGGGTKVEIKRTVAAPSVFIFP

SEQ ID NO: 795582 - protein, 139 aa, Homo sapiens
  misc_feature: NA.49.66.F11.1.454.light.4.multim50-aa
  MOD_RES (139)..(139): Any amino acid
MEAPAQLLFLLLLWLPDTTGEIVLTQSPVTLSMSPGERATLSCRASQNVGSYLAWYQQKPGQAPSLLIFDASRRAADIPARFSGSGFGTDFTLTISSLEPEDFAVYYCQQRTTGFTFGPGTRVDIKRTVAAPSVFIFPX

SEQ ID NO: 795583 - protein, 140 aa, Homo sapiens
  misc_feature: NA.51.23.C01.1.454.light.4.multim50-aa
MEAPAQLLFLLLLWLPDTIGETVLTQSPATLSLSPGERATLSCRASESIDIFLAWYQQKPGQAPRLLIYDASKRVVGIPARFSGSGSGTEFTLTITRLEPEDFAVYYCQQRNNWLSFGGGTKVEIKRTVAAPSVFIFPPS

SEQ ID NO: 795584 - protein, 140 aa, Homo sapiens
  misc_feature: NA.48.58.F03.5.454.light.4.multim50-aa
METPAQLLFLLLLWLPDTAGEILLTQSPGTLSLSPGERATLSCRASQYVSSNYLAWYQQKPGQAPRLLIYGASSRAIGIPDRFSGSGSGTNFTLTISRLEPEDFAVYYCQQYTNSPKTFGQGTKVEIKRTVAAPSVFIFP

SEQ ID NO: 795585 - protein, 147 aa, Homo sapiens; identical to SEQ ID NO: 795125
  misc_feature: NA.48.58.F03.6.454.light.4.multim50-aa

SEQ ID NO: 795586 - protein, 143 aa, Homo sapiens
  misc_feature: NA.48.58.F03.3.454.light.4.multim50-aa
MAWTVLLLGLLSHCTGSVTSYVLTQPPSVSVAPGKTARITCGGNNIGSKSVHWYQQKPGQAPVLVVFDDTDRPSGIPERFSGSNSVNTATLTISRVEAGDEADYYCQVWDSSSDHPNWVFGGGTKLTVLGQPKAAPSVTLFPT

SEQ ID NO: 795587 - protein, 139 aa, Homo sapiens; identical to SEQ ID NO: 795460
  misc_feature: NA.48.29.C07.2.454.light.4.multim50-aa

SEQ ID NO: 795588 - protein, 143 aa, Homo sapiens
  misc_feature: NA.3.87.H10.1.454.light.4.multim50-aa
MAWALLFLTLLTQGTGSWAQPALTQPASVSGSPGQSVTISCTGSTGDVATYKFVSWSWYQKHPGKAPRLMIYDVSDRPSGVSHRFSGSKSGNTASLTISGLQAEDEADYFCSSYTTGTTVVVFGGGTKLTVLGQPKAAPSVTP

SEQ ID NO: 795589 - protein, 149 aa, Homo sapiens
  misc_feature: NA.12.67.G01.1.454.light.4.multim50-aa
MAWALLFLTLLTQGTGSWAQSALTQPASVSGSPGQSITISCTGTSSDVGGYNYVSWYQQHPGRAPKLMIFDVTNRPSGVSDRFSGSKSDYTASLTISGLQAEDEADYYCSSYTSSSTLFVFGSGTKVTVLRQPKAQPHSSLCSHPPLRR

SEQ ID NO: 795590 - protein, 146 aa, Homo sapiens
  misc_feature: NA.52.59.F04.2.454.light.4.multim50-aa
MDMRVPAQLLGLLLLWLSGARCDIQMTQSPSSLSASVGDRVTFTCRASQDISNYLNWYQQKPGKAPKLLIYDASNLETGVPSRFTGSGSGTHFTFTISGLQPEDFATYYCQQYEDLPLTFGGGTKVEIRRTVAAPSVFIFRHLIYD

SEQ ID NO: 795591 - protein, 133 aa, Homo sapiens; identical to SEQ ID NO: 795466
  misc_feature: NA.49.37.D04.2.454.light.4.multim50-aa

SEQ ID NO: 795592 - protein, 143 aa, Homo sapiens
  misc_feature: NA.49.37.D04.1.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTLVPV

SEQ ID NO: 795593 - protein, 143 aa, Homo sapiens
  misc_feature: NA.49.37.D04.6.454.light.4.multim50-aa
  MOD_RES (141)..(141): Any amino acid
MAWIPLLLPLLTLCTGSEASSELQQTSSVSASPGQTARITCSGDALAKQFASWFQQKPGQAPILMIYKGSERPSGIPERFSGSHSGATAVLTITGVQAEDEADYYCQSADNTIVSVFFGGGTRLTVLGQPKAAPSVTLFPXSS

SEQ ID NO: 795594 - protein, 136 aa, Homo sapiens
  misc_feature: NA.49.37.D04.8.454.light.4.multim50-aa
  MOD_RES (22)..(22): Any amino acid
  MOD_RES (24)..(25): Any amino acid
MEAPAQLLFLLLLWLPDTTGEXVXXQSPATLSVSPGERVTLSCRASQSVRSNLAWYQQKPGQAPRLLIYGASTRATGIPARFSGSGSGTEFTLTISSLQSEDFAVYYCQQYNVRAPDTFGGGTKVEIKRTVAAPSV

SEQ ID NO: 795595 - protein, 144 aa, Homo sapiens
  misc_feature: NA.49.17.B06.1.454.light.4.multim50-aa
MAWALLFLTLLTQGTGSWAQSALTQPASVSGSPGQSITISCTGTSGDVGVYNYVSWYQHHPGKAPKLMIYDVSDRPSGVSNRFSGSKSGNTASLTISGLQAEDEADYYCSSYTTSNNWVFGGGTKLTVLGQPKAAPSVTLFPPS

SEQ ID NO: 795596 - protein, 138 aa, Homo sapiens
  misc_feature: NA.49.17.B06.2.454.light.4.multim50-aa
MAWIPLLLPLLTLCTGSEASYELTQSPSVSVSSGQTARITCSGDALPKQYAYWYQQRPGQAPVLVIYKDFERPSGTPERFSGSSSGTTVTLTISGVRPEDEADYYCQSADSSGSYVVFGGGTTLTVLGQPKAAPSVTF

SEQ ID NO: 795597 - protein, 136 aa, Homo sapiens
  misc_feature: NA.43.77.G11.2.454.light.4.multim50-aa
  MOD_RES (131)..(131): Any amino acid
MAWIPLFLGVLAYCTGSVAAYELTQPPSVSVSPGQTASITCSGDKLGDKYASWYQQKPGESPVLVIYQDDKRPSGIPERFSGSNSGNTATLTISGTQAMDEADFYCQAWDTNTVVFGGGTKLTVLGQPKAXPLGLP

SEQ ID NO: 795598 - protein, 142 aa, Homo sapiens
  misc_feature: NA.48.81.H04.2.454.light.4.multim50-aa
METPAQLLFLLLLWLPDTTGEVLLTQSPGTLSLSPGERATLSCRASQTVISSSLAWYQQKPGQAPRLLIYGASSRAAGIPDRFSGSGSGTDFTLTISRLEPEDFAVYFCQQYGGSPAYSFGQGTKLEIKRTVAAPSVFIFPP

SEQ ID NO: 795599 - protein, 138 aa, Homo sapiens
  misc_feature: NA.48.81.H04.4.454.light.4.multim50-aa
MTCSPLLLTLLIHCTGSWAQSVLTQPPSVSAAPGQKVTISCSGSSSNIGNNYVSWYQQLPGTAPKLLIYDNNKRPSGIPDRFSGSKSGTSATLGITGLQTGDEADYYCGTWDNSPSGGRVFGGGTKLTVLRQPKAAPR

SEQ ID NO: 795600 - protein, 139 aa, Homo sapiens
  misc_feature: NA.48.81.H04.5.454.light.4.multim50-aa
MAWIPLFLGVLAYCTGSVASYELTQPPSVSVSPGQTASISCFGHKLGEKYVCWYQQKPGQSPVLVIREDNKRPSGIPERFSGSNSGNTATLTIRGTQALDEADYHCQAWDSNTAIFGGGTRLTVGGQPKAAPSVTLFPP

SEQ ID NO: 795601 - protein, 142 aa, Homo sapiens
  misc_feature: NA.43.14.B03.1.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTDLGQPKANPTVYSSR

SEQ ID NO: 795602 - protein, 148 aa, Homo sapiens
  misc_feature: NA.43.34.D01.1.454.light.4.multim50-aa
  MOD_RES (143)..(143): Any amino acid
MAWALLLLTLLAQDTGSWAQSALTQPASVSGSPGQSITISCTGTSSDVGSYSLVSWYQVHPGKAPKLMIYEGTKRPSGVSDRFSGSKSGNTASLTISGLQAEDEADYYCCSYAGSYTYVFGIGTTVTVLGQPKANPYGHSVPXLLTTH

SEQ ID NO: 795603 - protein, 140 aa, Homo sapiens
  misc_feature: NA.48.59.F04.4.454.light.4.multim50-aa
MAWTPLLLPLLTFCTVSEASYELTQPPSVSVSPGQTARITCSGDALPKKYAYWYQQKSGQAPVLVIFEDNKRPSGIPERFSGSSSGTMATLTINGAQVDDEADYYCSSTDSSGDRGLFGGGTKLTVLSQPKAAPSVTLFP

SEQ ID NO: 795604 - protein, 138 aa, Homo sapiens; identical to SEQ ID NO: 795581
  misc_feature: NA.52.55.E11.1.454.light.4.multim50-aa

SEQ ID NO: 795605 - protein, 136 aa, Homo sapiens
  misc_feature: NA.52.55.E11.6.454.light.4.multim50-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKAAPSV

SEQ ID NO: 795606 - protein, 141 aa, Homo sapiens
  misc_feature: NA.18.26.C04.1.454.light.4.multim50-aa
MDMRVPAQLLGLLLLWFPGSRCDIQMTQSPSSVAASVGDRVSITCRTSQHISWLIWYQQKAGKAPNLLIKGPSSFQSGASTRFSGSGSGTDFTLTITSLQPEDFATYYCQQADRFPLTFGGGTKVEIKGTVAAPSVFIFPP

SEQ ID NO: 795607 - protein, 133 aa, Homo sapiens; identical to SEQ ID NO: 795466
  misc_feature: NA.49.55.E11.3.454.light.4.multim50-aa

SEQ ID NO: 795608 - protein, 138 aa, Homo sapiens
  misc_feature: NA.49.55.E11.6.454.light.4.multim50-aa
MEAPAQLLFLLLLWLPDTTGESVLSQSPATLSLSPGERATLSCRATQSVSTYLAWYQQRPGQPPRLLIYDTSNRATGIPARFSGSGSGTDFTLTISSLEPEDFAVYYCQQRYNWPPMYTFGQGTKLEIRRTVAAPSVF

SEQ ID NO: 795609 - protein, 145 aa, Homo sapiens
  misc_feature: NA.17.33.C11.1.454.light.4.multim50-aa
MAWTPLFLFLLTCCPGSNSQTVVTQEPSLTVSPGGTVTLTCASNTGAVTSAYYPNWFQQKPGQAPRALIYSTNNKHSWTPARFSGSLLGGKAALTLSGVQPEDEADYYCLLYFGGAVLFGGGTKLTVLSQPKAAPSVTLFPPSSY

SEQ ID NO: 795610 - protein, 141 aa, Homo sapiens
  misc_feature: NA.40.38.D05.1.454.light.4.multim50-aa
MAGFPLLLTLLTHCAGSWAQSVLTQPPSASGTPGQRVTISCSGSNSNIGTNYVYWYQQLPGTAPKVLFYRNNQRPSGVPDRFSASKSGTSVSLAISGLRSEDEGDYYCAAWDESLRGWLFGGGTKLTVLGQPKARPLGHSS

SEQ ID NO: 795611 - protein, 135 aa, Homo sapiens
  misc_feature: NA.4.59.F04.1.454.light.4.multim50-aa
MAWIPLFLGVLAYCTGSVASYEVTQPPSVSVSPGQTAGITCSGDKLGHKFASWYQQKPGQSPILVIYQDTKRPSGIPERFSGSNSGNTATLTITGTQAVDEADYYCQAWDSSTEVFGGGTKLTVLRQPKAAPSVY

SEQ ID NO: 795612 - protein, 133 aa, Homo sapiens
  misc_feature: NA.51.60.F05.1.454.light.4.multim50-aa
MAWIPLFLGVLAYCTGFVASYELIQPPSVSVSPGQTASITCSGDKLRDKYAAWYQQKPGQSPVVVIYQDTKRPSGIPERFSGSTSGNTATLTISGTQAVDEADFYCQAWDSDTAVFGGGTKLTVLGQPKAPPP

SEQ ID NO: 795613 - protein, 142 aa, Homo sapiens; identical to SEQ ID NO: 795598
  misc_feature: NA.48.12.B01.2.454.light.4.multim50-aa

SEQ ID NO: 795614 - protein, 140 aa, Homo sapiens
  misc_feature: NA.49.60.F05.3.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFIFPP

SEQ ID NO: 795615 - protein, 136 aa, Homo sapiens
  misc_feature: NA.49.60.F05.7.454.light.4.multim50-aa
  MOD_RES (19)..(19): Any amino acid
  MOD_RES (115)..(115): Any amino acid
  MOD_RES (130)..(130): Any amino acid
MDMRVPAQLLGLLLLWLSXARCVIQMTQSPSSLSASIGDRITITCRASRDISMYLNWYQQKPGTAPKLLILDASTLETGVPSRFSGSGSGTDFTFTISRLQPEDIATYYCQQYDXLPLTFGGGPNGGGSXRTVAAP

SEQ ID NO: 795616 - protein, 134 aa, Homo sapiens
  misc_feature: NA.4.33.C11.2.454.light.4.multim50-aa
MDMWVPAQLLGLLLLWLPGAKCDIQMTQSPSTLSASLGDRVTITCRASQSISNSLAWYQQRPGRAPKLLISDASNLHSGVPPTFSGSGSGTEFTLTISSLQPDDVATYYCQQYDSYWTFGQGTKIEIKRTVAAP

SEQ ID NO: 795617 - protein, 148 aa, Homo sapiens
  misc_feature: NA.49.29.C07.4.454.light.4.multim50-aa
MAGFPLLLTLLTHCAGSWAQSVLTQPPSASGTPGQRVIISCSGGKGNIGSNFAYWYQQLPGTAPKFLLYRSNQRPSGVPDRFSGSQSGTSASLAISGLRSEDEADYYCAAWDDSLSGLVFGAGTKVTVLGQPKANPTVTLFPPSSLST

SEQ ID NO: 795618 - protein, 141 aa, Homo sapiens
  misc_feature: NA.49.29.C07.5.454.light.4.multim50-aa
  MOD_RES (141)..(141): Any amino acid
MSPSQLIGFLLLWVPASWGEVVLTQSPDFHSVTPKEKVTITCRASQNIGNNLHWYQQKPDQSPKLLIKFATQSFSGVPSRFSGSGSGTDFTLTISSLEPEDAAAYYCHQTITLPETFGQGTKVEIKRTVAAPSVFIFPPFX

SEQ ID NO: 795619 - protein, 135 aa, Homo sapiens
  misc_feature: NA.48.25.C03.2.454.light.4.multim50-aa
METPAQLLFLLLLWLPDTTGALVLTQSPGTLSLSPGERATLSCRASQSVSGGSVAWYQQKRGQVPRLLIYDASSRATGIPDRFSGSGSGTDFTLTISRLEPEDFAVYYCQQYGSSPQLTFGGGTKVEIKRTVAAP

SEQ ID NO: 795620 - protein, 137 aa, Homo sapiens
  misc_feature: NA.48.25.C03.6.454.light.4.multim50-aa
  MOD_RES (19)..(19): Any amino acid
MAWALLLFILLTQDTGSWXQSALTQPASMSGSPRQSITVSCTGTSSDVGRYDLVSWYQQHPGKAPKLLIYEITKRPSGVSNRFSGSKSGNTASLTISGLQAEDEADYYCCSYAGGTTWVFGRGTKLTVLGQPKARPL

SEQ ID NO: 795621 - protein, 140 aa, Homo sapiens
  misc_feature: NA.52.37.D04.2.454.light.4.multim50-aa
MAWALLFLTLLTQGTGSWAQSALTQPASVSGSPGQSITISCTGTSNDIGTYNSVSWYQQYPGKVPKLMIFEVSDRPAGVSHRFSGSKSGSTASLTISGLQAEDEADYYCSSYTNRNTWVFGGGTKLTVLRQPKAAPSVTL

SEQ ID NO: 795622 - protein, 137 aa, Homo sapiens
  misc_feature: NA.52.37.D04.5.454.light.4.multim50-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKARPLGL

SEQ ID NO: 795623 - protein, 148 aa, Homo sapiens
  misc_feature: NA.43.35.D02.1.454.light.4.multim50-aa
MAWALLLLTLLTQGTGSWAQSALTQPPSASGSPGQSVTISCTGSSSDIGGYTYVSWYQQHPGKAPKLMIYEVNKRPSGVPDRFSGSKSGNTATLTVSGLQAEDEAHYYCSSYTGNKNLVFGGGTELTVLGQPKAAPSVTLFPPSSLLT

SEQ ID NO: 795624 - protein, 137 aa, Homo sapiens; identical to SEQ ID NO: 795458
  misc_feature: NA.43.35.D02.4.454.light.4.multim50-aa

SEQ ID NO: 795625 - protein, 140 aa, Homo sapiens
  misc_feature: NA.49.22.B11.1.454.light.4.multim50-aa
MEAPAQLLFLLLLWLPDISEEIVLTQSPATLYLSPGERATLSCRASQSVNNFLGWYQQKPGQVPRLLVYDASIRATGIPARFSGSGSGTDFTLTISSLEPEDFAVYYCQQRSNLITFGQGTRLEIKRTVAAPSVFIFPPS

SEQ ID NO: 795626 - protein, 135 aa, Homo sapiens
  misc_feature: NA.49.77.G11.1.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSV

SEQ ID NO: 795627 - protein, 141 aa, Homo sapiens
  misc_feature: NA.43.23.C01.2.454.light.4.multim50-aa
MAWALLFLTLLTQGTGSWAQSALTQPASVSGSPGQSITISCTGSSSDVGTYDHVSWYQQYPGKAPKLLIYDVTYRPSGVSYRFSGSKSGNTASLTISGLQAEDEADYYCNSLTTTDTCVFGGGTKLTVLGQPKAAPSVTLV

SEQ ID NO: 795628 - protein, 146 aa, Homo sapiens
  misc_feature: NA.51.34.D01.1.454.light.4.multim50-aa
MAWALLFLTLLTQGTGSWAQSALTQPASVSGSPGQSITISCTGTSGDIGVYNYVSWYQHHPGKAPKLMIYDVSDRPSGVSNRFSGSKSGNTASLTISGLQAEDEADYYCSSYTINNNWVFGGGTKLTVLGQPKAAPSVTLVPTLLS

SEQ ID NO: 795629 - protein, 138 aa, Homo sapiens; identical to SEQ ID NO: 795504
  misc_feature: NA.51.34.D01.6.454.light.4.multim50-aa

SEQ ID NO: 795630 - protein, 137 aa, Homo sapiens; identical to SEQ ID NO: 795507
  misc_feature: NA.48.38.D05.1.454.light.4.multim50-aa

SEQ ID NO: 795631 - protein, 135 aa, Homo sapiens; identical to SEQ ID NO: 795529
  misc_feature: NA.48.38.D05.4.454.light.4.multim50-aa

SEQ ID NO: 795632 - protein, 137 aa, Homo sapiens
  misc_feature: NA.52.34.D01.2.454.light.4.multim50-aa
MAWIPLLLPLLTLCTGSGASYELTQPPSVSVSSGQTARITCSGDALPKQYGYWYQQRPGQAPLLVIYKDHERPSGIPERFSGSSSGTTVTLIISGVRAEDEADYYCQSTDSSGTYVQFGGGTKLTVLGQPKAAPSVY

SEQ ID NO: 795633 - protein, 138 aa, Homo sapiens; identical to SEQ ID NO: 795581
  misc_feature: NA.52.34.D01.4.454.light.4.multim50-aa

SEQ ID NO: 795634 - protein, 142 aa, Homo sapiens
  misc_feature: NA.52.34.D01.7.454.light.4.multim50-aa
MAWALLLLTLLTQGTGSWAQSALTQPPSASGSPGQSVTISCTGSSSDVGAYDFVSWYQHHPGKAPKLIIFEVTKRPSGVPDRFSGSKSGNTASLTVSGLQAEDEADYYCTSYAGDNNLGVFGGGTKVTVLRQPKAAPSVTSV

SEQ ID NO: 795635 - protein, 140 aa, Homo sapiens
  misc_feature: NA.52.34.D01.3.454.light.4.multim50-aa
MEAPAQLLFLLLLWLPDTTGEIVLTQSPATLSLSPGERATLSCRASQSISNYLAWYQQKPGQAPRLLIYDASNRATGIPARFSGGGSGTDFTLTISSLEPEDFAVYYCQQRSNWPPITFGQGTRLEIKRTVAAPSVFIPA

SEQ ID NO: 795636 - protein, 140 aa, Homo sapiens
  misc_feature: NA.48.52.E08.2.454.light.4.multim50-aa
MAWTALLLSLLAHFTDSVASYELTQPFSVSVALGQTARMTCGGNKIGSKDVHWYQHKPGQAPLLVIYRDTNRPSGIPERISGSNSGNTATLTISGAQAGDEADYFCQVWDSSSVIFGGGTKLTVLGQPKAAPSVTLFPPS

SEQ ID NO: 795637 - protein, 141 aa, Homo sapiens
  misc_feature: NA.41.38.D05.1.454.light.4.multim50-aa
MDMRVPAQLLGLLLLWFPGSRCDIQMTQSPSSVSASVGDRVTITCRASQGIGSYLVWYQQKPGKAPKLLIYGSSSLQSGVPSRFSGSGSGTHFTLTISSLQPEDFATYYCQQADSFPLTFGGGTKVETKRTVAAPSVFISP

SEQ ID NO: 795638 - protein, 136 aa, Homo sapiens
  misc_feature: NA.4.57.F02.2.454.light.4.multim50-aa
MDMRVPAQLLGLLLLWLRDARCDTQMTQSPSSLSASVGDRVIISCRASQSVSIYLNWYQFKPGKAPKLLIYAASSLQSGVPSRFSGSGSGTDFTLTISSLQPEDFATYYCQQSYDTPPLTFGGGTKVEIKRTVAAP

SEQ ID NO: 795639 - protein, 143 aa, Homo sapiens; identical to SEQ ID NO: 795046
  misc_feature: NA.12.71.G05.1.454.light.4.multim50-aa

SEQ ID NO: 795640 - protein, 144 aa, Homo sapiens; identical to SEQ ID NO: 795532
  misc_feature: NA.41.55.E11.3.454.light.4.multim50-aa

SEQ ID NO: 795641 - protein, 138 aa, Homo sapiens
  misc_feature: NA.41.55.E11.5.454.light.4.multim50-aa
MAWIPLFLGVLASCTVSVASSELTQAPSVSVSPGQTARITCSGDTLGETFASWYQQRPGQSPILVIFQDDKRPSGIPERFSGSRSGNRATLTITETQAVDEADYYCQAWDRNTGIFGGGTKLTVLRQPKAAPSVTLFP

SEQ ID NO: 795642 - protein, 139 aa, Homo sapiens; identical to SEQ ID NO: 795248
  misc_feature: NA.49.82.H05.1.454.light.4.multim50-aa

SEQ ID NO: 795643 - protein, 134 aa, Homo sapiens
  misc_feature: NA.51.55.E11.4.454.light.4.multim50-aa
MAWIPLFLGVLAYCTGFVASYELTQPPSVSVSPGQTASVTCSGDKLRDRYVSWYQQKPGQSPVVVIYQDTKRPSGIPERFSGSNSGNTATLTISGTQAVDEADFYCQAWDSDTAVFGGGTKLTVLGQPKAAPSV

SEQ ID NO: 795644 - protein, 135 aa, Homo sapiens
  misc_feature: NA.51.55.E11.5.454.light.4.multim50-aa
METPAQLLFLLLLWLPDTSGEIVLTQSPGTLSLFPGDRATLSCRASQSFSSNYLAWYQQKPGQAPRLLIYGASSRAAGIPDRFSGSGSGTDFSLTISGLEPEDFAVYYCQHHGSSSRYTFGRGTKLEIKRTVAAP

SEQ ID NO: 795645 - protein, 136 aa, Homo sapiens; identical to SEQ ID NO: 795155
  misc_feature: NA.51.55.E11.6.454.light.4.multim50-aa

SEQ ID NO: 795646 - protein, 137 aa, Homo sapiens; identical to SEQ ID NO: 795494
  misc_feature: NA.48.86.H09.1.454.light.4.multim50-aa

SEQ ID NO: 795647 - protein, 146 aa, Homo sapiens
  misc_feature: NA.48.86.H09.3.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLFPPSSMYT

SEQ ID NO: 795648 - protein, 139 aa, Homo sapiens; identical to SEQ ID NO: 795446
  misc_feature: NA.48.86.H09.6.454.light.4.multim50-aa

SEQ ID NO: 795649 - protein, 144 aa, Homo sapiens
  misc_feature: NA.51.27.C05.1.454.light.4.multim50-aa
MAWALLFLTLLTQGTGSWAQSALTQPASVSGSPGQSITISCTGTSSDVGGYNYVSWYQHHPGKAPKLMIYDVSDRPSGVSNRFSGSKSGNTASLTISGLQAEDEADYYCTSYTSSNNWVFGGGTKLTVLGQPKAAPSVTLVPPS

SEQ ID NO: 795650 - protein, 136 aa, Homo sapiens
  misc_feature: NA.48.41.D08.3.454.light.4.multim50-aa
MEAPAQLLFLLLLWLPDTTGEVLMTQSPATLSVSPGERATLSCRASQSVSSNLAWYQQKPGQAPRLIIYGASTRATGCPARFSGSGSGTEFSLTISSLQSEDFAVYYCQQYDNWPPFTFGGGTKVEIKRTVAAPSS

SEQ ID NO: 795651 - protein, 139 aa, Homo sapiens
  misc_feature: NA.48.41.D08.7.454.light.4.multim50-aa
  MOD_RES (108)..(108): Any amino acid
MDMRVPAQLLGLLLLWLPGAKCDIQMTQSPSTLSASVGDRVTITCRASQSISDWLAWYQQKPGKAPNLLIYQASTLESGVPSRFSGSGSETEFTLTISSLQPDDYATXYCQQYTSLWTFGQGTKVGNTNETVAAPSVFI

SEQ ID NO: 795652 - protein, 140 aa, Homo sapiens
  misc_feature: NA.49.42.D09.5.454.light.4.multim50-aa
MSPSQLIGFLLLWVPASWGEVVLTQSPDFHSVTPKEKVTITCRASQNIGNNLHWYQQKPDQSPKLLIKFATQSFSGVPSRFSGSGSGTDFTLTISSLEPEDAAAYYCHQTITLPETFGQGTKVEIKRTVAAPSVLLLFPA

SEQ ID NO: 795653 - protein, 135 aa, Homo sapiens
  misc_feature: NA.48.57.F02.5.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKARPR

SEQ ID NO: 795654 - protein, 133 aa, Homo sapiens
  misc_feature: NA.49.35.D02.3.454.light.4.multim50-aa
MAWIPLLLPLLTLCTDSEASYELTQPPSVSVSSGQTASITCSGDALPKQYAYWYQQKPGQAPVLIIYKDFERASGTPERFSGSSSATTVTLTISGVRAEDEADYYCQSSDSSGTSVVFGGGTKLTVLGQPKAR

SEQ ID NO: 795655 - protein, 135 aa, Homo sapiens; identical to SEQ ID NO: 795453
  misc_feature: NA.49.35.D02.5.454.light.4.multim50-aa

SEQ ID NO: 795656 - protein, 144 aa, Homo sapiens
  misc_feature: NA.49.35.D02.7.454.light.4.multim50-aa
MAWTPLLLPLLTFCTVSEASYELTQPPSVSVSPGQTARITCSGDALTKKYACWYQKKSGQAPVLLIYDDRKRPSGIPERFSGSTSGTMATLTISGAQVEDEGDYYCYSPDTSENHRGIFGGGTKLTVLGQPKARPLGHSRSHPP

SEQ ID NO: 795657 - protein, 145 aa, Homo sapiens
  misc_feature: NA.48.27.C05.2.454.light.4.multim50-aa
MEAPAQLLFLLLLWLPESTGDIELTQSPGTLSLSPGERATLSCRAGRSLSSTYLAWYQQKAGQAPRLLIYDVSTRATGIPDRFSGSGSGTDFTLTINRLEPEDSAVYFCQQYRSSVSYTFGQGTTLEIKRTVAAPSVFIFPPSDM

SEQ ID NO: 795658 - protein, 140 aa, Homo sapiens
  misc_feature: NA.48.27.C05.3.454.light.4.multim50-aa
MEAPAQLLFLLLLWLPAATGEIVLTQSPATLSLSPGQRASLSCRASQHVSTYLAWYQQKPGQAPRLLIYDASTRATGVPARFSASGSGTDFTLTISSLEPEDFAVYYCQQRANWPLTFGGGTKVDIKRTVAAPSVFIFPL

SEQ ID NO: 795659 - protein, 135 aa, Homo sapiens; identical to SEQ ID NO: 795488
  misc_feature: NA.48.27.C05.4.454.light.4.multim50-aa

SEQ ID NO: 795660 - protein, 146 aa, Homo sapiens
  misc_feature: NA.48.27.C05.7.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLVPTLLYVY

SEQ ID NO: 795661 - protein, 134 aa, Homo sapiens; identical to SEQ ID NO: 795455
  misc_feature: NA.48.62.F07.1.454.light.4.multim50-aa

SEQ ID NO: 795662 - protein, 142 aa, Homo sapiens
  misc_feature: NA.47.83.H06.2.454.light.4.multim50-aa
MAWALLLLTLLTQGTGSWAQSAPTQPASVSGSPGQSITISCTGTSSDVGSSDSISWYQQHPGKAPKLIIYDVNVRPSGVSHRFSGSKSGNTASLTISGLESEDEADYFCCSWATTVVWVFGGGTKLTVLGQPKAAPSVTLFP

SEQ ID NO: 795663 - protein, 149 aa, Homo sapiens
  misc_feature: NA.40.27.C05.1.454.light.4.multim50-aa
MAGFPLLLTLLTHCAGSWAQSVLTQPPSASETPGQQVTVSCSGSSSNIGSNSVYWYQCLPGTAPKLLVYRDYQRPLGVPDRFSGSRSGTSASLAISGLRPEDEADYYCVSWDDRMNGPVFGGGTRLTVLGQPKAAPSVTLVPTLLSRSV

SEQ ID NO: 795664 - protein, 140 aa, Homo sapiens
  misc_feature: NA.3.10.A10.2.454.light.4.multim50-aa
MEAPAQLLFLLLLWLPDATGEIVMAQSPATLSVSPGERATLSCRASQSVYNNLAWYQQRPGQAPRLLMFGASTRATGIPARFSGSGSGTEFTLTISSLQSEDFAIYFCQQYNNWPLTFGQGTKVETKRTVAAPSVFIFPP

SEQ ID NO: 795665 - protein, 142 aa, Homo sapiens
  misc_feature: NA.51.53.E09.1.454.light.4.multim50-aa
MAWALLFLTLLTQGTGSWAQSALTQPASVSGSPGQSITISCTGTTNDIGTYNSVSWYQQYPGKVPKLMIFEVSDRPAGVSHRFSGSKSGSTASLTISGLQAEDEADYYCSSYTNRNTWVFGGGTKLTVLRQPKAAPSVTLVP

SEQ ID NO: 795666 - protein, 139 aa, Homo sapiens
  misc_feature: NA.51.53.E09.3.454.light.4.multim50-aa
MDMRVPAQLLGLLLLWLPDTRCDIQMTQSPSSLSASIGDRVTITCRASQGVSIYLAWYQQRPGKAPKLLIYEASTLQSGVPSRFSGSGSGAHFTLTISSLQPDDVATYYCQNYNRAVALTFGGGTEGGESRRTVAAPSV

SEQ ID NO: 795667 - protein, 142 aa, Homo sapiens; identical to SEQ ID NO: 795294
  misc_feature: NA.48.61.F06.1.454.light.4.multim50-aa

SEQ ID NO: 795668 - protein, 137 aa, Homo sapiens
  misc_feature: NA.48.78.H01.2.454.light.4.multim50-aa
MAWALLLFILLTQDTGSWAQSALTQPASMSGSPRQSITVSCTGTSSDVGRYDLVSWYQQHPGKAPKLLIYEITKRPSGVSNRFSGSKSGNTASLTISGLQAEDEADYYCCSYAGGTTWVFGRGTKLTVLGQPKAAPS

SEQ ID NO: 795669 - protein, 137 aa, Homo sapiens; identical to SEQ ID NO: 795632
  misc_feature: NA.52.28.C06.3.454.light.4.multim50-aa

SEQ ID NO: 795670 - protein, 139 aa, Homo sapiens
  misc_feature: NA.40.23.C01.1.454.light.4.multim50-aa
MEAPAQLLFLLLLWLPDTTGEIVLTQSPATLSLSPGERATLSCRASQSLSNYLVWYQQKPGQAPRLLIYDASSRATGIPARFSGSGSGTDFTLTISGLEPEDFAVYYCQQRTNWPLTFGGGTKVEIKRTVAAPSVFIPR

SEQ ID NO: 795671 - protein, 143 aa, Homo sapiens
  misc_feature: NA.48.60.F05.3.454.light.4.multim50-aa
MDMRVPAQLLGLLLLWFPGSRCDIQMTQSPSSVSASVGDRVTITCRASQDVSPLLAWYQQKPGKAPKLLIFAVSSLQSGVPSRFSGSGSGAEFILTINSLQPEDFATYYCQQGDSFPPTFGGGTRVDVKRTVAAPSVFIFPPI

SEQ ID NO: 795672 - protein, 146 aa, Homo sapiens
  misc_feature: NA.48.60.F05.5.454.light.4.multim50-aa
  MOD_RES (141)..(141): Any amino acid
METPAQLLFLLLLWLPDTAGEILLTQSPGTLSLSPGERATLSCRASQYVSSNYLAWYQQKPGQAPRLLIYGASSRAIGIPDRFSGSGSGTNFTLTISRLEPEDFAVYYCQQYTNSPKTFGQGTKVEIKRTVAAPSVFIFPXSDMYT

SEQ ID NO: 795673 - protein, 134 aa, Homo sapiens; identical to SEQ ID NO: 795455
  misc_feature: NA.48.60.F05.9.454.light.4.multim50-aa

SEQ ID NO: 795674 - protein, 139 aa, Homo sapiens
  misc_feature: NA.11.57.F02.2.454.light.4.multim50-aa
MEAPAQLLFLLLLWLPGTTGDIVLTQSPATLSVSPGDRATLSCRASQTISYTLAWYQQKPGQAPRLLIYGASTRAAGVPPRFSGGGSGTVFTLTISSLQSEDFAVYYCQQYSKWPLTFGGGTKVEIRRTVAAPSVFIFP

SEQ ID NO: 795675 - protein, 135 aa, Homo sapiens
  misc_feature: NA.48.33.C11.1.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKACPP

SEQ ID NO: 795676 - protein, 143 aa, Homo sapiens
  misc_feature: NA.13.10.A10.1.454.light.4.multim50-aa
MSVPTMAWMMLLLGLLAYGSGVDSQTVVTQEPSFSVSPGGTVTLTCGLRYGSVSSSYYPSWYQQTPGQAPRTLIYNTNTRSSGVPHRFSGSILGNKAALIITGAQAEDESDYYCVLYMGSAISAVFGGGTRLTVLGQPKAAPS

SEQ ID NO: 795677 - protein, 140 aa, Homo sapiens
  misc_feature: NA.48.33.C11.6.454.light.4.multim50-aa
MEAPAQLLFLLLLWLPDSTGQIVMTQSPATLSVSPGERVTLSCRASESLDSSLAWYQQRPGQPPRLLIYDTSTRATGVPARFTGGGSGTEFTLTISSLQSEDFTFYYCQQYRKWTPTFGQGTKVEVKRTVAAPSVFILPA

SEQ ID NO: 795678 - protein, 134 aa, Homo sapiens; identical to SEQ ID NO: 795508
  misc_feature: NA.48.37.D04.4.454.light.4.multim50-aa

SEQ ID NO: 795679 - protein, 145 aa, Homo sapiens
  misc_feature: NA.41.14.B03.1.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVLGQPKAAPSVYSRSRP

SEQ ID NO: 795680 - protein, 137 aa, Homo sapiens; identical to SEQ ID NO: 795632
  misc_feature: NA.52.87.H10.7.454.light.4.multim50-aa

SEQ ID NO: 795681 - protein, 144 aa, Homo sapiens
  misc_feature: NA.49.30.C08.6.454.light.4.multim50-aa
MDMRVPAQLLGLLLLWLRGARCDIQMTQSPSSLSASVGDRVTIICRASQSISNYLNWYQHTPGKAPRLLIYAAANLQSGVPSRFSGSGSGTEFTLTISSLQPEDFGKYYCQQSYGNLLIFGGGTKVEIKRTVAAPSVFIFPPSD

SEQ ID NO: 795682 - protein, 139 aa, Homo sapiens; identical to SEQ ID NO: 795446
  misc_feature: NA.48.53.E09.1.454.light.4.multim50-aa

SEQ ID NO: 795683 - protein, 139 aa, Homo sapiens
  misc_feature: NA.49.30.C08.3.454.light.4.multim50-aa
MSPSQLIGFLLLWVPASWGEVVLTQSPDFHSVTPKEKVTITCRASQNIGNNLHWYQQKPDQSPKLLIKFATQSFSGVPSRFSGSGSGTDFTLTISSLEPEDAAAYYCHQTITLPETFGQGTKVEIKRTVAAPSVFIFPP

SEQ ID NO: 795684 - protein, 139 aa, Homo sapiens; identical to SEQ ID NO: 795683
  misc_feature: NA.49.41.D08.5.454.light.4.multim50-aa

SEQ ID NO: 795685 - protein, 142 aa, Homo sapiens
  misc_feature: NA.48.28.C06.4.454.light.4.multim50-aa
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKAAPSVTLFPPS

SEQ ID NO: 795686 - protein, 140 aa, Homo sapiens
  misc_feature: NA.13.55.E11.3.454.light.4.multim50-aa
MRLPAQLLGLLMLWVPGSSGDVVMTQSPLSLPVTLGQPASISCRSSQSLVYSDGKTYLNWFQQRPGQSPRRLIYNVFTRDSGVPDRFSGSGSGTDFTLKITRVEAEDVGIYYCMQATFWPFTFGPGTKVDTNRTVAAPSV

SEQ ID NO: 795687 - protein, 138 aa, Homo sapiens
  misc_feature: NA.49.24.C02.6.454.light.4.multim50-aa
MDMRVPAQLLGLLLLWLPGAKCDIQMTQSPSLLSASVGDRVTITCRATENINRWLAWYQQKPGKAPEALIYLASSLESGVPSRFSGNGSGTEFTLTISSLQPEDFGKYYCQQSYGNLLIFGGGTKVEIKRTVAAPSVF

SEQ ID NO: 795688 - protein, 145 aa, Homo sapiens; identical to SEQ ID NO: 795459
  misc_feature: NA.48.68.G02.4.454.light.4.multim50-aa

SEQ ID NO: 795689 - protein, 142 aa, Homo sapiens
  misc_feature: NA.40.53.E09.1.454.light.4.multim50-aa
  MOD_RES (134)..(134): Any amino acid
MSVPTMAWMMLLLGLLAYGSGVDSQAAVTQEPSFSVSPGGTVTLTCGRSSGAVSPVHYPSWYQQTPGQPPRSLIVSTSRRLPGVPDRFSASILGNKAALTITGAQPEDESYYYCMLHVGGATWVFGGGTKLTVXGQPKAAPS

SEQ ID NO: 795690 - protein, 139 aa, Homo sapiens
  misc_feature: NA.48.77.G11.5.454.light.4.multim50-aa
  MOD_RES (131)..(131): Any amino acid
  MOD_RES (133)..(133): Any amino acid
MVLQTQVFISLLLWISGACGDIVMTQSPDSLAVSLGETATINCKSSQSVFHTSMNKEYLAWFQQKPGQPPKLLIYSASTRKSGVPDRFRGSGSGTDFTLTISSLQAEDVAVYYCQQYYYTPPTFGRGTDVXYXRTVAAP

SEQ ID NO: 795691 - protein, 143 aa, Homo sapiens
  misc_feature: NA.41.35.D02.2.454.light.4.multim50-aa
MAWALLLLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVLGQPKARPLGHSRS

SEQ ID NO: 795692 - protein, 134 aa, Homo sapiens; identical to SEQ ID NO: 795455
  misc_feature: NA.48.77.G11.2.454.light.4.multim50-aa

SEQ ID NO: 795693 - protein, 139 aa, Homo sapiens
  misc_feature: NA.51.29.C07.3.454.light.4.multim50-aa
MDMRVPTQLLGLLLLWLSGARCDIQMTQSPSSLSASVGDRVTITCQASQDISNNLIWYQQKPGRAPSLMIYDASILEDGVPSRFSGSGSGTNFSFTITNLQPEDFATYFCQQYDNVPTVTFGGGTKVDLKRTVAAPSVF

SEQ ID NO: 795694 - protein, 138 aa, Homo sapiens
  misc_feature: NA.40.42.D09.1.454.light.4.multim50-aa
MAWTPLLLPLLTFCTVSEASYELTQPPSVSVSPGQTARITCSGEALPKKYAYWYQQKSGQAPVLVIYEDNKRPSEIPERFSGSSSGTMATLALSGAQVEDEADYYCYSVDSSGNHGVFGGGTKLTVLGQPKAAPSVTL

SEQ ID NO: 795695 - protein, 139 aa, Homo sapiens
  misc_feature: NA.49.34.D01.1.454.light.4.multim50-aa
MAWIPLLLPLLTLCTGSEASSELQQTSSVSASPGQTARITCSGDALAKQFASWFQQKPGQAPILMIYKGSERPSGIPERFSGSHSGATAVLTITGVQAEDEADYYCQSADNTIVSVVFGGGTRLTVLGQPKAAPSVHSS

SEQ ID NO: 795696 - protein, 142 aa, Homo sapiens
  misc_feature: NA.49.34.D01.6.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKARPLGHSRS

SEQ ID NO: 795697 - protein, 146 aa, Homo sapiens; identical to SEQ ID NO: 795628
  misc_feature: NA.51.38.D05.1.454.light.4.multim50-aa

SEQ ID NO: 795698 - protein, 140 aa, Homo sapiens
  misc_feature: NA.49.78.H01.7.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTL

SEQ ID NO: 795699 - protein, 147 aa, Homo sapiens
  misc_feature: NA.49.38.D05.1.454.light.4.multim50-aa
MDMRVPAQLLGLLLLWLSGARCDIQMTQSPSSLSASVGDRVTITCQASQDIRNYLNWYQQKPGKAPKLLIYDVSNLETGVPSRFSGSGSGTDFTFTISSLQPEDIATYYCQQYDNLPLTFGGGTKVEIKRTVAAPSVFIFPPSDLST

SEQ ID NO: 795700 - protein, 144 aa, Homo sapiens
  misc_feature: NA.13.37.D04.3.454.light.4.multim50-aa
MAWIPLFLGVLAYCSASMASYKVTQAPSVSVPPGQTAIITCSGDKLGEKFASWYQKKPGQSPVVVIYQDTKRPSGIPERFSGSNSGNTATLTINGTQAMDEADYYCQVWDSNTYVVFGGGTKLTVLGQPKAAPSVTLFPPSSST

SEQ ID NO: 795701 - protein, 139 aa, Homo sapiens
  misc_feature: NA.48.55.E11.9.454.light.4.multim50-aa
MAWTPLLLPLLTFCTVSEASYELTQPPSVSVSPGQTARITCSGDALPKKYAYWYQQKSGQAPVLVIFEDNKRPSGIPERFSGSSSGTMATLTINGAQVDDEADYYCSSTDSSGDRGLFGGGTKLTVLSQPKARPLGHSS

SEQ ID NO: 795702 - protein, 136 aa, Homo sapiens
  misc_feature: NA.52.72.G06.1.454.light.4.multim50-aa
MDMRVPAQLLGLLLLWLSGARCVIQMTQSPSSLSASVGDRVTITCQASQDISNYLNWYQLKPGKAPKLLILDAFTLETGVPSRFSGSGSGTDFTFTISSLQPEDIATYYCQQYDNLPLTFGGGPKVEIKRTVAAPS

SEQ ID NO: 795703 - protein, 137 aa, Homo sapiens
  misc_feature: NA.41.37.D04.5.454.light.4.multim50-aa
MAWALLLLTLLTQDTGSWAQSALTQPASVSGSPGQSITISCTGTISDVDYYNLVSWYQQHPGKAPKLLIYEGDQRPSGVSDRFSGSKSGNTASLTVSRLQAEDEADYYCFSYADTKSWVFGGGTKLTVLGQPKAAPS

SEQ ID NO: 795704 - protein, 138 aa, Homo sapiens
  misc_feature: NA.41.12.B01.4.454.light.4.multim50-aa
MDMRVLAQLLGLLLLCFPGARCDIQMTQSPSSLSASVGDRVTITCRASQDISNYLAWFQQKPGNAPKSLIYAASTLRSGVPSKFSGGRSGTDFTLTISNLQPEDFATYYCQQYSTFPLTFGGGTRVEIKRTVAAPSVF

SEQ ID NO: 795705 - protein, 139 aa, Homo sapiens
  misc_feature: NA.48.35.D02.1.454.light.4.multim50-aa
MAWTPLLLPLLTFCTVSEASYELTQPPSVSVSPGQTARITCSGDALPKKYAYWYQQKSGQAPVLVIFEDNKRPSGIPERFSGSSSGTMATLTINGAQVDDEADYYCSSTDSSGDRGLFGGGTKLTVLSQPKARPLGPLS

SEQ ID NO: 795706 - protein, 141 aa, Homo sapiens; identical to SEQ ID NO: 795498
  misc_feature: NA.48.35.D02.7.454.light.4.multim50-aa

SEQ ID NO: 795707 - protein, 144 aa, Homo sapiens
  misc_feature: NA.52.27.C05.2.454.light.4.multim50-aa
MDMRVPAQLLGLLLLWLRGARCDTQMTQSPSSLSASVGDRVTITCRASQSIGRYLNWYQQKPGKAPRLLIYAASRLQSGVPSRFSGRGSGTDFTLTISSLQPEDFAIYYCQQSDNTPQTFGPGTRVDIKRTVAAPSVFYSRHLI

SEQ ID NO: 795708 - protein, 142 aa, Homo sapiens
  misc_feature: NA.52.27.C05.4.454.light.4.multim50-aa
MEAPAQLLFLLLLWLPDTTGEIVLTQSPATLSLSPGERATLSCRASQSISNYLAWYQQKPGQAPRLLIYDASNRATGIPARFSGGGSGTDFTLTISSLEPEDFAVYYCQQRSNWPPITFGQGTRLEIKRTVAAPSVFIFPAI

SEQ ID NO: 795709 - protein, 149 aa, Homo sapiens
  misc_feature: NA.43.27.C05.1.454.light.4.multim50-aa
MAGFPLLLTLLTHCAGSWAQSVLTQPPSASGTPGQRVTISCSGTYSNIGSNYVYWYQQLPGTAPKLLIYRNNQRPSGVPDRFSGSKSGTSASLAIRGLRSEDEADYYCATWDDTLSAYVVFGGGTKLTVQGQPKAAPSVTLFPPSSLLT

SEQ ID NO: 795710 - protein, 146 aa, Homo sapiens
  misc_feature: NA.49.72.G06.3.454.light.4.multim50-aa
METPAQLLFLLLLWLPDTTAEIVLTQSPGTLSLSPGERATLSCRASQSVSNSYVAWYQQKPGQSPRLLIYAASSRATGIPDRFSGSGSGTDFSLTISRLEPEDFAVYYCQHGSIRALTFGGGTKVEIKRTVAAPSVFIFPPSDLST

SEQ ID NO: 795711 - protein, 139 aa, Homo sapiens
  misc_feature: NA.51.37.D04.9.454.light.4.multim50-aa
  MOD_RES (58)..(58): Any amino acid
  MOD_RES (73)..(73): Any amino acid
  MOD_RES (77)..(78): Any amino acid
  MOD_RES (90)..(90): Any amino acid
  MOD_RES (100)..(100): Any amino acid
  MOD_RES (111)..(112): Any amino acid
  MOD_RES (125)..(125): Any amino acid
  MOD_RES (129)..(129): Any amino acid
MEAPAQLLFLLLLWLPDSTGEIVLTQSPGTLSLSPGERATLSCRASQSVSHFLAWYQXKPGQAPRLLIYDASXRATXXPARFSGSGSGTXFTLTISSLZXEDFAIYYCQQXXNWPPSITFGQGHXLEIXRTVAAPSCLL

SEQ ID NO: 795712 - protein, 135 aa, Homo sapiens; identical to SEQ ID NO: 795453
  misc_feature: NA.49.53.E09.3.454.light.4.multim50-aa

SEQ ID NO: 795713 - protein, 134 aa, Homo sapiens
  misc_feature: NA.52.35.D02.5.454.light.4.multim50-aa
METPAQLLFLLLLWLPDITGEIVLTQSPGTLSLSPGERATLSCRTSQSISNSYLAWYQQNPGQAPRLLIYGASSRATGIPDRFSGSGSGTDFTLTISRVEPEDFAVYYCQHYGRSQYTFGQGTKLEIKRTVAAP

SEQ ID NO: 795714 - protein, 137 aa, Homo sapiens
  misc_feature: NA.52.59.F04.1.454.light.4.multim50-aa
MDMRVPAQLLGLLLLWLPDTRCDIQMTQSPSSLSASVGDRVTISCRASQVINSYLAWYQQKPGQVPELLIYDTSTLQSGVPSRFVGSGSGTDFTLTISSLQPEDVATYFCHNYDDAPHTFGQGTKLEIKRTVAAPSV

SEQ ID NO: 795715 - protein, 136 aa, Homo sapiens
  misc_feature: NA.49.37.D04.5.454.light.4.multim50-aa
  MOD_RES (99)..(99): Any amino acid
MDMRVPAQLLGLLLLWLSGARCVIQMTQSPSSLSASIGDRITITCRASQDISMYLNWYQQKPGTAPKLLILDASTLETGVPSRFSGSGSGTDFTFTISXLQPEDIATYYCQQYDSLPLTFGGGTEGGDTRRTVAAP

SEQ ID NO: 795716 - protein, 143 aa, Homo sapiens
  misc_feature: NA.41.21.B10.2.454.light.4.multim50-aa
MDMRVPAQLLGLLLLWLPGAKCDIQMTQSPSTLSASVGDRVTITCRASQVINNWLAWYQQKPGKAPKLLIYKASTLESGVPSRFSGSGSGTEFTLTIGSLQPEDIATYYCQQYNTYSGAFGQGTKVEIKRTVAAPSVFIFPPT

SEQ ID NO: 795717 - protein, 144 aa, Homo sapiens
  misc_feature: NA.40.87.H10.1.454.light.4.multim50-aa
MAGFPLLLTLLTHCAGSWAQSVLTQPPSASGTPGQRVTISCSGSNSNIGTNYVYWYQQLPGTAPKVLFYRNNQRPSGVPDRFSASKSGTSVSLAISGLRSEDEGDYYCAAWDESLRGWLFGGGTKLTVLGQPKAAPSVTLFPPS

SEQ ID NO: 795718 - protein, 136 aa, Homo sapiens
  misc_feature: NA.51.34.D01.2.454.light.4.multim50-aa
MAWIPLFLGVLAYCTGSLAAYDLTQPPSVSVSPGQTATITCSGDNLGSKYVSWYQHHPGRSPILLLYHDAKRPSGIPERFSGSNSGDTATLTIRGTQAVDEADYYCQAWDREAAIFGGGTSLTVLGQPKAAPSVTP

SEQ ID NO: 795719 - protein, 139 aa, Homo sapiens; identical to SEQ ID NO: 795461
  misc_feature: NA.48.52.E08.1.454.light.4.multim50-aa

SEQ ID NO: 795720 - protein, 133 aa, Homo sapiens
  misc_feature: NA.52.81.H04.4.454.light.4.multim50-aa
  MOD_RES (133)..(133): Any amino acid
MAWIPLFLGVLAYCTGSVASYELTQPPSVSVSPGQTASITCSGDKLGDKYVSWYQQKPGQSPALVIYQDTKRRSGIPERFSGSNSGDTATLTISGTQTLDEADYYCQAWDSSTGVFGGGTKLTVLGQPKAAPX

SEQ ID NO: 795721 - protein, 137 aa, Homo sapiens; identical to SEQ ID NO: 795703
  misc_feature: NA.41.55.E11.2.454.light.4.multim50-aa

SEQ ID NO: 795722 - protein, 144 aa, Homo sapiens; identical to SEQ ID NO: 795681
  misc_feature: NA.49.45.E01.4.454.light.4.multim50-aa

SEQ ID NO: 795723 - protein, 134 aa, Homo sapiens
  misc_feature: NA.48.86.H09.5.454.light.4.multim50-aa
  MOD_RES (134)..(134): Any amino acid
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKAAX

SEQ ID NO: 795724 - protein, 159 aa, Homo sapiens
  misc_feature: NA.18.78.H01.1.454.light.4.multim50-aa
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTQVFGTGTKVTVLGQPKANPTVTLFPPSSILVLVRRSRRRRLE

SEQ ID NO: 795725 - protein, 143 aa, Homo sapiens
  misc_feature: NA.11.57.F02.1.454.light.4.multim50-aa
MEAPAQLLFLLLLWLPDTTGEIVLTQSPATLSASPGETVTLSCRASQNINNYLAWFQQKPGQAPRLLIYDAFRRATGIPPRFSGSGSGTDFILTIRSLEPEDFAVYYCQQRSSRPPATFGQGTKVEVKRTVAAPSVFIFPPLS

SEQ ID NO: 795726 - protein, 148 aa, Homo sapiens
  misc_feature: NA.9.53.E09.1.454.light.4.multim50-aa
MAWALLLLTLLTQDTGSWAQSALTQPASVSGSPGQSITISCTGTSSDVGSYDLVSWYQQHPGKAPKLIIYEVTKRPSGVSIRFSGSKSDNTASLTISGLQAEDEADYYCCSYADGDTPVVFGGGTKVTVLGQPKAVPPSLCSRPPQTY

SEQ ID NO: 795727 - protein, 141 aa, Homo sapiens
  misc_feature: NA.8.28.C06.1.454.light.4.multim50-aa
MEAPAQLLFLLLLWLPEIIGEVVMTQSPVTLSVFPGERATLSCAASQSVRTNLAWYQQRPGQAPRLLIFGAFNRASGIPARFSGSGSGTSFTLTINNLQSDDFAVYFCQQSEDWPFTFGGGTKVDLKRTVAAPSVFIFPPI

SEQ ID NO: 795728 - protein, 149 aa, Homo sapiens
  misc_feature: NA.18.59.F04.1.454.light.4.multim50-aa
MAWALLFLTLLTQGTGSWAQSALTQPASVSGSPGQSITISCTGTSSDVGGYNYVSWYQQHPGKAPKLMIYDVTNRPSGVSNRFSGSKSGNTASLTISGLQAEDEADYYCSSYTSTSTLYVFGTGTKVTVLGQPKANPTRHSVPTLLHTR

SEQ ID NO: 795729 - protein, 136 aa, Homo sapiens
  misc_feature: NA.3.10.A10.1.454.light.4.multim50-aa
MAWIPLLLPLLTLCTDSEASYELTQPPSVSVSPGQTAKITCSGDALPKQYAYWYQQKPGQAPVVVIYKDSERPSGIPERFSGSSSGTTVTLTISGVQAEDEADYYCQSADNSNTYLYVFGSGTRVTVLGQPKANPT

SEQ ID NO: 795730 - protein, 134 aa, Homo sapiens
  misc_feature: NA.26.37.D04.1.454.light.4.multim50-aa
MEAPAQLLFLLLLWLPDTTGEIVMTQSPATLSVSPGERVTLSCRASQSVSRGLAWYQQTPGQTPRLLIYAASTRATGIPARFSGSGSGTEFTLTISSLQSEDCAIYYCQQYNTWPPLTFGGGTKVEIKRTVAAP

SEQ ID NO: 795731 - protein, 148 aa, Homo sapiens
  misc_feature: NA.41.53.E09.1.454.light.4.multim50-aa
  MOD_RES (144)..(144): Any amino acid
MAWALLFLTLLTQGTGSWAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVLGQPKARPLGHSVPXLLIV

SEQ ID NO: 795732 - protein, 150 aa, Homo sapiens
  misc_feature: NA.12.53.E09.1.454.light.4.multim50-aa
FAWALLLLTLLTQDTGSWAQSALTQPASVSGSPGQSITISCTGTSSDVGTYNLVSWYQQHPGKAPKLMIYEGTKRPSGVSYRFSGSESGNTASLTISGLQAEDEADYYCCSYAGSSTFDVLFGGGTKLTVLGQPKAAPSVTLFPPSSTSY

SEQ ID NO: 795733 - protein, 148 aa, Homo sapiens
  misc_feature: NA.18.11.A11.1.454.light.4.multim50-aa
MVLQTQVFISLLLWISGADGDIVMTQSPDSLVVSLGERATINCKSSQSVLYSSNNNNYLAWYQQKPGQPPKVLIYWASTRESGVPDRFRGSGSGTDFTLTITNLQAEDVAVYYCQQYYSPPLTFGGGTKVEIKRTVAAPSVFIFPPSD

SEQ ID NO: 795734 - protein, 138 aa, Homo sapiens
  misc_feature: NA.49.81.H04.1.454.light.4.multim50-aa
MDMRVPAQLLGLLLLWLSGARCDIRMTQSPSSLSASVGDRITITCQATQDISNYLNWYQQKPGKAPNLLIYDASNLEIGVPSRFSGSGSGTYFTFTIINLQPEDIATYYCQQYDNLPLTFGGGTTVEIKRTVAAPSVF

SEQ ID NO: 795735 - protein, 142 aa, Homo sapiens
  misc_feature: NA.19.10.A10.1.454.light.4.multim50-aa
METPAQLLFLLLLWLPDSTGEIFLTQSPGTLSLTPGERATLSCRADKSVDSTFFAWYQQRPGQAPRLLVYGASTRATGIPDRFSGSVSGTDFTLTISRLEPEDFAVYYCQRYDESPPWWTFGQGTKVEVKRTVAAPSVFIFP

SEQ ID NO: 795736 - protein, 146 aa, Homo sapiens
  misc_feature: NA.41.19.B08.1.454.light.4.multim50-aa
MAWALLSLTLLTQGTGSWAQSALTQPASVTGSPGQSITVSCSGSSSDVGAYNFVAWYQQHPGEAPRLIIYDVTDRPSGVSNRFSGSKSGDTASLTISGLQAEDEGDYFCSSFTTSHTLLFGTGTTVIVLGQPKANPTVTLFPPSSL

SEQ ID NO: 795737 - protein, 142 aa, Homo sapiens
  misc_feature: NA.49.28.C06.2.454.light.4.multim50-aa
  MOD_RES (138)..(138): Any amino acid
MEAPAQLLFLLLLWLPDTTGESVLSQSPATLSLSPGERATLSCRATQSVSTYLAWYQQRPGQPPRLLIYDTSNRATGIPARFSGSGSGTDFTLTISSLEPEDFAVYYCQQRYNWPPMYTFGQGTKLEIRRTVAAPSVXRSAT

SEQ ID NO: 795738 - protein, 139 aa, Homo sapiens; identical to SEQ ID NO: 795460
  misc_feature: NA.48.30.C08.1.454.light.4.multim50-aa

SEQ ID NO: 795739 - protein, 146 aa, Homo sapiens
  misc_feature: NA.43.87.H10.1.454.light.4.multim50-aa
MPWALLLLTLLTHSAVSVVQAGLTQPPSVSKGLRQTATLTCTGNSNNVGNQGAAWLQQHQGHPPKLLSYRNNNRPSGISERLSASRSGNTASLTITGLQPEDEADYYCSAWDSSLSAWVFGGGTKLTVLGQPKAAPSVTLVPALLT

SEQ ID NO: 795740 - protein, 136 aa, Homo sapiens
  misc_feature: NA.49.56.F01.2.454.light.4.multim50-aa
MDMRVPAQLLGLLLLWLRGARCDIQMTQSPSSLSASLGDRVTITCQASQTIGNFLNWYQHKPGKAPKLLIYAASTLQSGVPSRFRGGGSGTDFALTISSLQPEDFATYYCQQSFSDLTFGGGTTVDIKRTVAAPSV

SEQ ID NO: 795741 - protein, 136 aa, Homo sapiens
  misc_feature: NA.49.33.C11.1.454.light.4.multim50-aa
MEAPAQLLFLLLLWLPDTTGEIVMTQSPATLSVSPGERVTLSCRASQSVRSNLAWYQQKPGQAPRLLIYGASTRATGIPARFSGSGSGTEFTLTISSLQSEDFAVYYCQQYNVRAPDTFGGGTKVEIKRTVAAPSV

SEQ ID NO: 795742 - protein, 135 aa, Homo sapiens
  misc_feature: NA.26.78.H01.1.454.light.4.multim50-aa
MEAPAQLLFLLLLWLPDSTGDIVLTQSPATLSLSPGERATLSCRASQSVGSYLAWYQQKPGQAPRLLIYDASNRATGIPARFSGSESGTDFTLTISSLEPEDFALYYCQQRSNWPLTFGGGTRVEIRRTVAAPSV

SEQ ID NO: 795743 - protein, 142 aa, Homo sapiens
  misc_feature: NA.49.61.F06.1.454.light.4.multim50-aa
METPAQLLFLLLLWLPDTTAEIVLTQSPGTLSLSPGERATLSCRASQSVSNSYVAWYQQKPGQSPRLLIYAASSRATGIPDRFSGSGSGTDFSLTISRLEPEDFAVYYCQHGSIRALTFGGGTKVEIKRTVAAPSVFYLPAI

SEQ ID NO: 795744 - protein, 137 aa, Homo sapiens
  misc_feature: NA.49.41.D08.4.454.light.4.multim50-aa
MDMRVPAQLLGLLLLWLPGAKCDIQMTQSPSLLSASVGDRVTITCRATENINRWLAWYQQKPGKAPEALIYLASSLESGVPSRFSGNGSGTEFTLTISSLQPDDLATYYCQHYNSYMYIFGQGTKLEIKRTVAAPSS

SEQ ID NO: 795745 - protein, 133 aa, Homo sapiens
  misc_feature: NA.51.45.E01.2.454.light.4.multim50-aa
MAWIPLFLGVLAYCTGFVASYELIQPPSVSVSPGQTASITCSGDKLRDKYAAWYQQKPGQSPVVVIYQDTKRPSGIPERFSGSTSGNTATLTISGTQAVDEADFYCQAWDSDTAVFGGGTKLTVLGQPKARPL

SEQ ID NO: 795746 - protein, 139 aa, Homo sapiens
  misc_feature: NA.48.68.G02.2.454.light.4.multim50-aa
MLPSQLIGFLLLWVPASRGEIVLTQSPDFQSVTPKEKVTITCRASQSIRGSLHWYQQKPDQSPKLLIKYASESISGVPSRFSGSGSGTDFTLTINSLEAEDAATYYCHQTFSLRRTFGQGTRLEIKRTVAAPSVFIFPS

SEQ ID NO: 795747 - protein, 137 aa, Homo sapiens; identical to SEQ ID NO: 795145
  misc_feature: NA.49.57.F02.2.454.light.4.multim50-aa

SEQ ID NO: 795748 - protein, 143 aa, Homo sapiens
  misc_feature: NA.48.34.D01.5.454.light.4.multim50-aa
  MOD_RES (143)..(143): Any amino acid
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKARPLGHSRSRPX

SEQ ID NO: 795749 - protein, 137 aa, Homo sapiens
  misc_feature: NA.17.29.C07.1.454.light.4.multim50-aa
MAWALLLLTLLTQGTGSWAQSALTQPASVSGSPGQSIIIFCTGSSSDVGSYNYVSWYQQYPGKAPKLMIYEVSNRPSGVSNRFSGSKSGNTASLTISGLQAEDEGDYYCSSYRSGSTLVFGGGTKLTVLGQPKARPP

SEQ ID NO: 795750 - protein, 136 aa, Homo sapiens
  misc_feature: NA.40.35.D02.2.454.light.4.multim50-aa
MAWALLLLSLLTQGTGSWAHSTLTQPRSVSGSPGQSVTISCTGTSSDIGAYNSVSWYQQHPGKGPKLLIYDVTKRPSGVADRFSGSKSGDTASLTISGLQTEDEATYFCCSYAGSFALEVFGGGTELTVLRQPKAP

SEQ ID NO: 795751 - protein, 141 aa, Homo sapiens
  misc_feature: NA.48.42.D09.4.454.light.4.multim50-aa
METPAQLLFLLLLWLPDSTGEIVLTQSPGTLSVSPGERATLSCRASQSVSSSYLAWYQQKPGQAPRLLIYGASSRATGIPDRFSCSGSGTDFTLTISRLEPEDFAIYYCQQYGTSPRYTFGQGTKLEIKRTVAAPMSSILP

SEQ ID NO: 795752 - protein, 140 aa, Homo sapiens
  misc_feature: NA.52.33.C11.3.454.light.4.multim50-aa
MAWIPLLLPLLTLCTGSEASYELTQPPSVSVSSGQTARITCSGDALPKQYAYWYQQKPGQAPVLLIYKDFERPSGTPERFSGSSSATTVTLTISGVQAEDEADYYCQSSDSSGTYVVFGGGTKLTVLGQPKARPPVTLFP

SEQ ID NO: 795753 - protein, 147 aa, Homo sapiens
  misc_feature: NA.52.72.G06.2.454.light.4.multim50-aa
MAWALLFLTLLTQGTGSWAQSALTQPASVSGSPGQSITISCTGTSNDIGTYNSVSWYQQYPGKVPKLMIFEVSDRPAGVSHRFSGSKSGSTASLTISGLQAEDEADYYCSSYTNRNTWVFGGGTKLTVLRQPKAAPSVTLVPALLYT

SEQ ID NO: 795754 - protein, 136 aa, Homo sapiens; identical to SEQ ID NO: 795750
  misc_feature: NA.40.55.E11.1.454.light.4.multim50-aa

SEQ ID NO: 795755 - protein, 141 aa, Homo sapiens
  misc_feature: NA.48.80.H03.2.454.light.4.multim50-aa
  MOD_RES (126)..(126): Any amino acid
  MOD_RES (141)..(141): Any amino acid
MAWTVLLLGLLSHCTGSVTSYVLTQPPSVSVAPGKTARITCGGTNIGRRSVHWYQQKPGQAPLMIVYDDSDRPSGIPERVAGSNSGNTATLAISRVEAGDEADYYCQVWDNGGDHPVFGGGTKLTXLSQPKAAPSVTLFPX

SEQ ID NO: 795756 - protein, 138 aa, Homo sapiens
  misc_feature: NA.41.37.D04.2.454.light.4.multim50-aa
  MOD_RES (138)..(138): Any amino acid
MDMRVPAQLLGLLLLWFPGSRCDIQMTQSPSSVSASVGDRVTITCRASQGIGSYLVWYQQKPGKAPKLLIYGSSSLQSGVPSRFSGSGSGTHFTLTISSLQPEDFATYYCQQADSFPLTFGGGTKVETKRTVAAPSVX

SEQ ID NO: 795757 - protein, 134 aa, Homo sapiens
  misc_feature: NA.48.35.D02.3.454.light.4.multim50-aa
MAWIPLLLPLLILCTGSEASYELTQPPSVSVSPGQTARITCSAETLPSQFGFWYQQKSGQAPRLLMYRDSERSSGIPERFSGSSSGTTLTLTISEVRAEDEADYYCQSGDNTRTQVLFGGGTKLTVLGQPKARP

SEQ ID NO: 795758 - protein, 136 aa, Homo sapiens
  misc_feature: NA.16.86.H09.1.454.light.4.multim50-aa
MAWALLLLTLLTQGTGSWAQSALTQPASVSGSPGQSIIIFCTGSSSDVGSYNYVSWYQQYPGKAPKLMIYEVSNRPSGVSNRFSGSKSGNTASLTISGLQAEDEGDYYCSSYRSGSTLVFGGGTKLTVLGQPKARP

SEQ ID NO: 795759 - protein, 136 aa, Homo sapiens; identical to SEQ ID NO: 795536
  misc_feature: NA.43.55.E11.1.454.light.4.multim50-aa

SEQ ID NO: 795760 - protein, 135 aa, Homo sapiens; identical to SEQ ID NO: 795626
  misc_feature: NA.49.72.G06.1.454.light.4.multim50-aa

SEQ ID NO: 795761 - protein, 138 aa, Homo sapiens
  misc_feature: NA.43.24.C02.1.454.light.4.multim50-aa
MRLPAQLLGLLMLWVSGSSGDIVMTQSPLSLPVTPGEPASISCRSSQSLLHSNRNNYLDWYLQKPGQPPQLLIYLGSNRASGVPDRFSGSGSGTDFTLKISRVEAEDVGVYYCMQALQTPLTFGGGTKVEIKRTVAAP

SEQ ID NO: 795762 - protein, 142 aa, Homo sapiens
  misc_feature: NA.48.29.C07.1.454.light.4.multim50-aa
MAWVPLLLPLLTLCTGSQASYELTQPPSVSVSPGQTARITCSGDGLPTQYAYWYQKKPGQAPVLVIYQDTQRASGTPERFSGSSSGATVALTIREVQAEDEADYYCQSADNGGTYLVFGGGTKLNVLGQPKAAPSVTLVPAL

SEQ ID NO: 795763 - protein, 136 aa, Homo sapiens; identical to SEQ ID NO: 795234
  misc_feature: NA.52.75.G09.3.454.light.4.multim50-aa

SEQ ID NO: 795764 - protein, 136 aa, Homo sapiens
  misc_feature: NA.49.54.E10.2.454.light.4.multim50-aa
MDMRVPAQLLGLLLLWLPGARCDIQLTQSPSFLSASVGDRVTITCRASQGVSSYLAWYQQKPGKAPNLLIYAATTLQSGVPSRFSGSGSGTEFTLTISSLQPEDFATYYCHQVDAYPLTFGGGTKVEIRRTVAAPF

SEQ ID NO: 795765 - protein, 142 aa, Homo sapiens
  misc_feature: NA.49.55.E11.1.454.light.4.multim50-aa
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTLVP

SEQ ID NO: 795766 - protein, 137 aa, Homo sapiens
  misc_feature: NA.40.38.D05.2.454.light.4.multim50-aa
MAWALLLLSLLTQGTGSWAHSTLTQPRSVSGSPGQSVTISCTGTSSDIGAYNSVSWYQQHPGKGPKLLIYDVTKRPSGVADRFSGSKSGDTASLTISGLQTEDEATYFCCSYAGSFALEVFGGGTELTVLRQPKAPP

SEQ ID NO: 795767 - protein, 140 aa, Homo sapiens
  misc_feature: NA.49.29.C07.3.454.light.4.multim50-aa
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFIFPA

SEQ ID NO: 795768 - protein, 142 aa, Homo sapiens
  misc_feature: NA.13.38.D05.3.454.light.4.multim50-aa
MSVPTMAWMMLLLGLLAYGSGVDSQTVVTQEPSFSVSPGGTVTLTCGLRYGSVSSSYYPSWYQQTPGQAPRTLIYNTNTRSSGVPHRFSGSILGNKAALIITGAQAEDESDYYCVLYMGSAISAVFGGGTRLTVLGQPKARP

SEQ ID NO: 795769 - protein, 140 aa, Homo sapiens; identical to SEQ ID NO: 795528
  misc_feature: NA.48.25.C03.1.454.light.4.multim50-aa

SEQ ID NO: 795770 - protein, 147 aa, Homo sapiens
  misc_feature: NA.43.23.C01.1.454.light.4.multim50-aa
MAWTPLFLFLLTCCPGSSSQTVVTQEPSLTVSPGGTVTLTCALVAGPVTSAYHPNWFQQKPGQGPTALIYGATNKHSWTPARFSGSLLGGKAALTLSGVQPEDEADYYCLLIYGGAWVFGGGTKLTVLGQPKAAPSVTLVPTLLYYS

SEQ ID NO: 795771 - protein, 133 aa, Homo sapiens
  misc_feature: NA.4.34.D01.1.454.light.4.multim50-aa
MEAPAQLLFLLLLWLPETTGEIVMTQSPGTLSVSPGDRATLSCRASQSVSSNLAWYLQKPGQAPRLLIYGASTRATGIPARFSASGSGTEFTLTISSLQSEDFAVYYCQQYDNWLYTFGQGTKLEIRRTVAAP

SEQ ID NO: 795772 - protein, 140 aa, Homo sapiens
  misc_feature: NA.49.68.G02.1.454.light.4.multim50-aa
  MOD_RES (138)..(138): Any amino acid
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVFIXPA

SEQ ID NO: 795773 - protein, 139 aa, Homo sapiens
  misc_feature: NA.53.53.E09.1.454.light.4.multim50-aa
MAWTPLLLPLLTFCTVSEASYELTQPPSVSVSPGQTARITCSGDALPRKYAYWYQQRSGQAPVLVIYEDTKRPSGIPARFSGASSGTVATLTVSGAQVEDEADYYCYSTDRSGNHRVFGGGTKLTVLGQPKARPLGHSR

SEQ ID NO: 795774 - protein, 139 aa, Homo sapiens; identical to SEQ ID NO: 795460
  misc_feature: NA.48.41.D08.4.454.light.4.multim50-aa

SEQ ID NO: 795775 - protein, 137 aa, Homo sapiens
  misc_feature: NA.52.41.D08.1.454.light.4.multim50-aa
MASFPLLLTLLTHCAGSWAQSVLTQPPSASGTPGQRVTISCSGGGSNIGGNTVNWYQQLPGTAPRLLIFSHNQRPSGVPDRFSGSKSGTSASLAISGLQSDDEADYFCATWDDSLNGPVFGGGTKLTVLGQPKAAPS

SEQ ID NO: 795776 - protein, 137 aa, Homo sapiens
  misc_feature: NA.49.42.D09.1.454.light.4.multim50-aa
  MOD_RES (137)..(137): Any amino acid
MEAPAQLLFLLLLWLPDTTGEIVLTQSPATLSLSPGDSATLSCRASQSVSSFLAWYQQKPGQAPRLLIYDASNRATGIPARFSGSGSVTDFTLTISSLEPEDSAVYYCQQRSNWPLTFGGGTKVEIKRTVAAPSVSX

SEQ ID NO: 795777 - protein, 143 aa, Homo sapiens
  misc_feature: NA.3.1.A01.1.454.light.4.multim50-aa
MDMWVPAQLLGLLLLWLPGAKCDIQMTQSPSTLSASLGDRVTITCRASQSISNSLAWYQQRPGRAPKLLISDASNLHSGVPPTFSGSGSGTEFTLTISSLQPDDVATYYCQQYDSYWTFGQGTKIEIKRTVAAPSVFIFPPSE

SEQ ID NO: 795778 - protein, 145 aa, Homo sapiens
  misc_feature: NA.47.55.E11.2.454.light.4.multim50-aa
GRETPPLGSCSSRLPWVGLELGTYEHSVGATVFSTVTISCSGSSSNIGNDNVYWYQQVPRTAPKLLIYNNDQRPSGVPGRFSGSKSGASATLAISGLRPEDEADYYCVGWDRSLTAYVFGAGTKVTVLGQPKANPTVTLFPPSST

SEQ ID NO: 795779 - protein, 144 aa, Homo sapiens
  misc_feature: NA.51.12.B01.2.454.light.4.multim50-aa
MAWTPLWLTLLTLCIGSVVSSELTQDPTVSVALGQTVRITCQGDNLRMFYAHWYQHKPGQAPLLVIYGRDNRPSGIPDRFSGSISGNTASLTITGAQAEDEADYYCNTRDSSDKVMIFGGGTKLTVLRQPKARPLGHSVPTLLS

SEQ ID NO: 795780 - protein, 143 aa, Homo sapiens
  misc_feature: NA.49.35.D02.1.454.light.4.multim50-aa
  MOD_RES (143)..(143): Any amino acid
MAWALLFLTLLTQGTGSWAQSALTQPASVSGSPGQSITISCTGTTNDVGTYNSVSWYQQYPGKVPKLMIFEVSDRPAGVSHRFSGSKSGSTASLTISGLQAEDEADYYCSSYTNINTWVFGGGTKLTVLRQPKAAPSVTLVPX

SEQ ID NO: 795781 - protein, 138 aa, Homo sapiens; identical to SEQ ID NO: 795487
  misc_feature: NA.48.27.C05.5.454.light.4.multim50-aa

SEQ ID NO: 795782 - protein, 139 aa, Homo sapiens
  misc_feature: NA.43.53.E09.1.454.light.4.multim50-aa
  MOD_RES (138)..(138): Any amino acid
MAWALLLLTLLAQDTGSWAQSALTQPASVSGSPGQSITISCTGTSSDVGSYSLVSWYQVHPGKAPKLMIYEGTKRPSGVSDRFSGSKSGNTASLTISGLQAEDEADYYCCSYAGSYTYVFGIGTTVTVLGQPKANPYXP

SEQ ID NO: 795783 - protein, 140 aa, Homo sapiens; identical to SEQ ID NO: 795614
  misc_feature: NA.49.80.H03.5.454.light.4.multim50-aa

SEQ ID NO: 795784 - protein, 139 aa, Homo sapiens; identical to SEQ ID NO: 795460
  misc_feature: NA.48.61.F06.4.454.light.4.multim50-aa

SEQ ID NO: 795785 - protein, 138 aa, Homo sapiens
  misc_feature: NA.52.29.C07.1.454.light.4.multim50-aa
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYFCQSSDISGTYVFGTGTKVTVLGQPKANPTVTLA

SEQ ID NO: 795786 - protein, 145 aa, Homo sapiens
  misc_feature: NA.13.11.A11.2.454.light.4.multim50-aa
METPAQLLFLLLLWLPDTTGEIVLTQSPGIVSLSPGERATLSCRASQIVSSNYLAWYQQKPGQAPRLLIYDVFRRTTDIPDRFSGSGSGTDFTLTISRLEPEDFALYFCHQYGRSPYTFGQGTKLEIKRTVAAPSVFIFPPSDST

SEQ ID NO: 795787 - protein, 136 aa, Homo sapiens
  misc_feature: NA.51.33.C11.3.454.light.4.multim50-aa
MAWIPLFLGVLAYCTGSLAAYDLTQPPSVSVSPGQTATITCSGDNLGSKYVSWYQHHPGRSPILLLYHDAKRPSGIPERFSGSNSGDTATLTIRGTQAVDEADYYCQAWDREAAIFGGGTSLTVLGQPKARPLGHS

SEQ ID NO: 795788 - protein, 141 aa, Homo sapiens
  misc_feature: NA.40.73.G07.1.454.light.4.multim50-aa
METPAQLLFLLLLWLPETTGEIVLKQSPDTLSLSPGERATLSCRASQSVSSNSIAWYQQKPGQSPRLLIYGASTRLTGIPDRFTASGSGTDFTLIITRLEPEDFAVYFCQQHDKSPFSFGRGTQVEIRRTVAAPSVFIFPA

SEQ ID NO: 795789 - protein, 143 aa, Homo sapiens
  misc_feature: NA.49.27.C05.3.454.light.4.multim50-aa
MDMRVPAQLLGLLLLWLSGARCVIQMTQSPSSLSASIGDRITITCRASRDISMYLNWYQQKPGTAPKLLILDASTLETGVPSRFSGSGSGTDFTFTISRLQPEDIATYYCQQYDSLPLTFGGGPKVEIKRTVAAPICLHPSRH

SEQ ID NO: 795790 - protein, 146 aa, Homo sapiens
  misc_feature: NA.48.87.H10.4.454.light.4.multim50-aa
  MOD_RES (141)..(141): Any amino acid
MAWTPLLLPLLTFCTVSEASSELTQPPSVSVSPGQTARITCSGDALPRKFCYWYQLKSGQAPVLVIYEDDQRPSRIPARFSGSNSGTLATLTITGAQVEDEGDYFCFSTDTSDNHAIFGGGTKLTVLGQPKARPLGHSRSXPPLCI

SEQ ID NO: 795791 - protein, 138 aa, Homo sapiens
  misc_feature: NA.49.58.F03.3.454.light.4.multim50-aa
MEAPAQLLFLLLLWLPDTTGEIVLTQSPVTLSMSPGERATLSCRASQNVGSYLAWYQQKPGQAPSLLIFDASRRAADIPARFSGSGFGTDFTLTISSLEPEDFAVYYCQQRTTGFTFGPGTRVDIKRTVAAPSVFIFP

SEQ ID NO: 795792 - protein, 133 aa, Homo sapiens; identical to SEQ ID NO: 795466
  misc_feature: NA.49.53.E09.4.454.light.4.multim50-aa

SEQ ID NO: 795793 - protein, 148 aa, Homo sapiens
  misc_feature: NA.48.59.F04.3.454.light.4.multim50-aa
MASFPLLLTLLTHCAGSWAQSVLTQPPSASGTPGQSVTISCSGSGSNIGRNTVNWYQQLPGAAPRLYIYNNYRRPSGVPDRVSASKSGTSASLAISGLRSEEEGDYYCAAWDDSLNAWVFGGGTKLTVLGQPKAAPSVTLFPPSSMYT

SEQ ID NO: 795794 - protein, 142 aa, Homo sapiens
  misc_feature: NA.19.67.G01.2.454.light.4.multim50-aa
MVLQTQVFISLLLWISGSCGDIVMTQYPDSLAVSLGETATINCRSSQNIFSTSKNKNFLAWYQQRPGQPPKLLIYWASTREFGVPDRFRGSGSGTDFTLTISSLQAEDVAVYYCQQLFFYPPWTFGQGTRVEIRRTVAAPSV

SEQ ID NO: 795795 - protein, 140 aa, Homo sapiens
  misc_feature: NA.52.37.D04.3.454.light.4.multim50-aa
MEAPAQLLFLLLLWLPDTTGEIVLTQSPATLSLSPGERATLSCRASQSISNYLAWYQQKPGQAPRLLIYDASNRATGIPARFSGGGSGTDFTLTISSLEPEDFAVYYCQQRSNWPPITFGQGTRLEIKRTVAAPSVFIFP

SEQ ID NO: 795796 - protein, 143 aa, Homo sapiens
  misc_feature: NA.51.55.E11.1.454.light.4.multim50-aa
MAWALLFLTLLTQGTGSWAQSALTQPASVSGSPGQSITISCTGTSGDIGVYNYVSWYQHHPGKAPKLMIYDVSDRPSGVSNRFSGSKSGNTASLTISGLQAEDEADYYCSSYTINNNWVFGGGTKLTVLGQPKACPLGHYSFP

SEQ ID NO: 795797 - protein, 187 aa, Homo sapiens
  misc_feature: NA.17.25.C03.G17C3.Sanger.heavy.1.sanger-aa
MDWTWRILFLVAAATSAHSQVQLVQSGAEVKKPGASVKVSCKASGFTFTSYSINWVRQAAGQRPEWMGWANPNTGVTVSSPILRDRLTMTTNSSINTAYMELRSLTSDDTAVYYCARVPRSGEPTAAAFDFWGQGALVTVTSASTKGPSVFPLAPCSRSTSESTAALGCLVKDYFPEPVTVSWNSRA

SEQ ID NO: 795798 - protein, 180 aa, Homo sapiens
  misc_feature: NA.3.70.G04.G3G42.Sanger.heavy.1.sanger-aa
MEFWLSWVFLVAISKGVQCEVQLVETGGGLIQPGGSLRLSCEVSGFTVSSNYMNWVRQAPGKGPEWVSIIYGDGSTYYADSVQGRFTISRDNFKNTLLLQMNNLRTEDTAVYYCASSTVVNVGVNWGLGTLVTVSSASTKGPSVFPLAPCSRSTSESTAALGCLVKDYFPEPVTVSWNSG

SEQ ID NO: 795799 - protein, 178 aa, Homo sapiens
  misc_feature: NA.4.26.C04.G4C4.Sanger.heavy.1.sanger-aa
MEFGLSWLFLVAILKGVQCEVQLVESGGGLVQPGGSPRLSCTDSGFTFSSHAMSWVRQAPGKGLEWVSAISGGGGGGTYYANSVRGRFTISRDNSKNTLYLQMNSLRADDTAVYYCAKCLIATERSSGWCNWLDPWGQGTHVTVSSASTKGPSVFPLAPCSRSTSENTAALGCLVKTT

SEQ ID NO: 795800 - protein, 184 aa, Homo sapiens
  misc_feature: NA.8.33.C11.G8C11.Sanger.heavy.1.sanger-aa
MEFGLNWVFLVALLRGVQCQVQLVESGGGVVQPGRSQRLSYAASGFTFSSYGMHWVRQTPGKGLEWVAVVSSEGSVQWYADAVKGRFTISRDNSRNTMYLDLNSLSPEDTGVYYCTKEGGTSGSSKYSFDVWGQGTLVTVSSASTKGPSVFPLAPCSRSTSESTAALGCLVKDYFPEPVTVSWN

SEQ ID NO: 795801 - protein, 180 aa, Homo sapiens
  misc_feature: NA.8.38.D05.G8D5.Sanger.heavy.1.sanger-aa
MEFGLSWVFLVALLRGVQCQVQLVESGGGVVQPGRSLRLSCAGSGFTFSNYGVHWVRQAPGKGLEWLAVVSSEGSVQYYTDSVKGRFTISRDNSKNTMYLQMDSLRVEDTAVYYCTKEGGYSGSSKYYFDFWGQGTLVTVSSASTKGPSVFPLAPCSRSTSESTAALGCLVKDYFPEPVT

SEQ ID NO: 795802 - protein, 204 aa, Homo sapiens
  misc_feature: NA.8.39.D06.G8D6.Sanger.heavy.1.sanger-aa
  MOD_RES (181)..(181): Any amino acid
FGGKRKTDGPPRSSGAHSQVQLVQSGAEMKSPGASVKISCKASGYRFTAVYINWLRQAPGQGPEWMGRINPSGGGAEYAQRFQGRVSMTSDTSASTVYMEMRSLRLDDTAVYYCARIEEGGYNHGAFEFWGQGTMVIVSSASTKGPSVFPLAPSSKSTSGGTAALGCLVKDYFPEPVTVSXIPGPSPVVSIPFPRCFRVPGLYS

SEQ ID NO: 795803 - protein, 181 aa, Homo sapiens
  misc_feature: NA.8.42.D09.G8D9.Sanger.heavy.1.sanger-aa
  MOD_RES (177)..(177): Any amino acid
MEFWLGWVFLVAISKGVQCEVQLVENGGGLIQPGGSLRLSCAASGFTISRDYMSWARQAPGKGLEWVSVIYRDGGTHYADSVKGRFTVSRDNSKNMVYLQMNRLTAEDTAVYYCARHDYGEPWGQGTLVTVSSASTKGPSVFPLAPCSRSTSESTAALGCLVKDYFPEPVTVSWNSXALTS

SEQ ID NO: 795804 - protein, 179 aa, Homo sapiens
  misc_feature: NA.9.1.A01.G9A1.Sanger.heavy.1.sanger-aa
MEFGLSWIFLAAILKGVQCEVQLVESGGGSVKPGESLRLSCATSGFNFDIAWMSWARQAPGKGLEWVGRLKSKGSGGTADYASSVKGRFSISRDDARQMMYLQMNSLKIGDTALYFCVFISQWELRFTVGDFWGRGAMVTVSSASTKGPSVFPLAPCSRSTSESTAALGCLVKDYFPEP

SEQ ID NO: 795805 - protein, 177 aa, Homo sapiens
  misc_feature: NA.9.12.B01.G9B1.Sanger.heavy.1.sanger-aa
MEFGLSWVFLVAILKGVQCEVQLVESGGGLVQPGGSLKLSCAASGYTVSSNSMNWVRQAPGKGLEWVSVIYSGGNTYYADSVKGRFTISRDNSRNTLYLQMNSLRVEDTAVYYCARDVYAFDIWGQGTMVTVSSASTKGPSVFPLAPCSRSTSESTAALGCLVKDYFPEPVTVSWNS

SEQ ID NO: 795806 - protein, 179 aa, Homo sapiens; identical to SEQ ID NO: 795804
  misc_feature: NA.9.31.C09.G9C9.Sanger.heavy.1.sanger-aa

SEQ ID NO: 795807 - protein, 182 aa, Homo sapiens
  misc_feature: NA.10.1.A01.G10A1.Sanger.heavy.1.sanger-aa
MEFGLSWVFLVALLRGVQCQVQLAESGGGVVQPGRSLRLSCAASGFTFNTYGMHWVRQAPGKGLEWVALISYDGNVKFYADSVKGRFTISRDNSRNTLYLQMNSLRADDTAVYYCATEQLLNPFAIWGQGTMVAVSSASTKGPSVFPLAPCSRSTSESTAALGCLVKDYFPEPVTVSWNSGA

SEQ ID NO: 795808 - protein, 182 aa, Homo sapiens
  misc_feature: NA.10.1.A01.G10A1-2.Sanger.heavy.1.sanger-aa
MEFGLSWVFLVALLRGVQCQVQLAESGGGVVQPGRSLRLSCAASGFTFNTYGMHWVRQAPGKGLEWVALISYDGNVKFYADSVKGRFTISRDNSRNTLYLQMNSLRADDTAVYYCATEQLLNPFAIWGQGTMVAVSSASTKGPSVFPLAPCSRSTSESTAALGCLVKDYFPEPVTVSWNSRG

SEQ ID NO: 795809 - protein, 178 aa, Homo sapiens
  misc_feature: NA.10.35.D02.G10D2.Sanger.heavy.1.sanger-aa
MEFGLRWIFLAAILKGVQCDVQLVESGGGLVKPGGSLRLSCSASGFSVTNAWMSWVRQSPGKGLEWVGLIRSRPDGGTTEYAGFVKGRFAISIDESKNTVYLEMSSLESDDTGLYYCTTKSPTKTVGRDCWGQGALVTVSSASTKGPSVFPLAPCSRSTSESTAALGCLVKDYFPEPV

SEQ ID NO: 795810 - protein, 179 aa, Homo sapiens
  misc_feature: NA.10.38.D05.G10D5.Sanger.heavy.1.sanger-aa
MEFWLSWVFLVAISKGVHCEVQLVETGGGWIQPGGSLRLSCAASGFSISNDYMTWARQAPGKGLEWVSVIETDGTTYYSDSVKGRFTLSRDTSNNILYLHMHNLRVDDTATYYCARHDYAQFWGQGAQVTVSPASTKGPSVFPLAPCSRSTSESTAALGCLVKDYFPEPVTVSWKFRGP

SEQ ID NO: 795811 - protein, 182 aa, Homo sapiens
  misc_feature: NA.10.6.A06.G10A6.Sanger.heavy.1.sanger-aa
MELGLRWVFLVAILEGVLCEVQLVESGGGLVKPGGSLRLSCVASGFPLRSFSMNWVRQAPGKGLEWVATISSISSYIYYAESVKGRFTISRDDARNSMWLQMNSLGAEDTARYYCARALMVGDNWNDIFDFWGQGTLVTVSSASTKGPSVFPLAPSSKSTSGGTAALGCLVKDYFPEPVTVS

SEQ ID NO: 795812 - protein, 178 aa, Homo sapiens
  misc_feature: NA.10.79.H02.G10H2.Sanger.heavy.1.sanger-aa
MEFGLSWVFLVAIIKGVQCQVKLVESGGGLVKPGGSLRLSCAASGFASGLTFSDYYMTWVRQAPGKGLEWVSYIYPSGDTIYYADSVKGRFTISRDNAKNSLTLQMNTLRAEDTAVYYCARITRSPGYYLDTWGQGTLVTVSSASTKGPSVFPLAPCSRSTSESTAALGCLVKDYFPE

SEQ ID NO: 795813 - protein, 184 aa, Homo sapiens
  misc_feature: NA.10.9.A09.G10A9.Sanger.heavy.1.sanger-aa
MESGLNWVFLVALLRGVQCQVQLVESGGGVVQPGRSQRLSCAASGFTFSSYGMHWVRQTPGKGLEWVAVVSSEGSVQWYADAVKGRFTISRDNSRNTMYLDLNSLSPEDTGVYYCTKEGGTSGSSKYSFDVWGQGTLVTVSSASTKGPSVFPLAPCSRSTSESTAALGCLVKDYFPEPVTVSWN

SEQ ID NO: 795814 - protein, 199 aa, Homo sapiens
  misc_feature: NA.13.21.B10.G13B10.Sanger.heavy.1.sanger-aa
GGSTAILALLLAVLQGVCAEVQLVQSGAEVKKPGESLKISCKGFGNSFISHWIGWVRQMPGKGLEWMGIIYPGDSDTRYSPSFQGQVTISADKSISTAYLQWSSLKASDTAMYYCAKYAYYGNSPAYYYNGMDVWGQGTTVTVSSASTKGPSVFPLAPSSKSTSGGTAALGCLVKDYFPEPVTVSWIPGPSPVVSIPFP

SEQ ID NO: 795815 - protein, 206 aa, Homo sapiens
  misc_feature: NA.13.71.G05.G13G5.Sanger.heavy.1.sanger-aa
GGSTAILALLLAVLQGVCAEVQLVQSGAEVKKPGESLKISCKGFGNSFISHWIGWVRQMPGKGLEWMGIIYPGDSDTRYSPSFQGQVTISADKSISTAYLQWSSLKASDTAMYYCAKYAYYGNSPAYYYNGMDVWGQGTTVTVSSASTKGPSVFPLAPSSKSTSGGTAALGCLVKDYFPEPVTVSWNSGALTSGVHTFPAVLQSSG

SEQ ID NO: 795816 - protein, 176 aa, Homo sapiens
  misc_feature: NA.26.60.F05.G26F5.Sanger.heavy.1.sanger-aa
MEFGLSWLFLVAFLKGVQCEVQLLASGGDLVHPGGSLRLSCAASGFTFSNSVMGWVRQAPGKGLAWVSSIDENGGSTFYVDSVKGRFTISRDNFRSTLFLQMNSLRAEDTALYFCAKVYSSAPYAHFFDFWGKGILVTVSSASTKGPSVFPLAPCSRSTSESTAALGCLVKDYFPE

SEQ ID NO: 795817 - protein, 178 aa, Homo sapiens
  misc_feature: NA.47.2.A02.G47A2.Sanger.heavy.1.sanger-aa
MEFGLSWLFLVAFLKGVQCEVQLLESGGDLVHPGGSLRLSCAASGLTFSNSVMGWVRQAPGKGLEWVSSIDENGGSTFYVDSVKGRFTISRDNFRSTLYLQMNSLRAEDTAVYFCAKVYSSAPYAHFFDFWGQGILVTVSTASTKGPSVFPLAPCSRSTSESTAALGCLVKDYFPEPV

SEQ ID NO: 795818 - protein, 179 aa, Homo sapiens
  misc_feature: NA.47.46.E02.G47E2.Sanger.heavy.1.sanger-aa
MEFGLSWLFLVAFLKGVQCEVQLLESGGDLVHPGGSLRLSCAASGLTFSNSVMGWVRQAPGKGLEWVSSIDENGGSTFYVDSVKGRFTISRDNFRSTLYLQMNSLRAEDTAVYFCAKVYSSAPYAHFFDFWGQGILVTVSTASTKGPSVFPLAPCSRSTSESTAALGCLVKDYFPEPVT

SEQ ID NO: 795819 - protein, 184 aa, Homo sapiens
  misc_feature: NA.40.81.H04.G40H4.Sanger.heavy.1.sanger-aa
  MOD_RES (181)..(181): Any amino acid
MDWTWRILFLVAAAAGAHSQVQLVQSGAEVKKPGASVKVSCKISGNTLSNYYIHWMRQAPGQGFEWMGWINPTRGGTKYRQNFQGRVTMTWDASISTVYMDLSGLTSDDTAMYYCGRDVGGYRGADHWGQGTLVTVSSASTKGPSVFPLAPCSRSTSESTAALGCLVKDYFPEPVTVSWNXRGP

SEQ ID NO: 795820 - protein, 181 aa, Homo sapiens
  misc_feature: NA.41.2.A02.G41A2.Sanger.heavy.1.sanger-aa
MDWTWRILFLVAAATGAHSQVQLMQSGAEVRKPGASVKLSCKTSGYRFNDFYIHWVRQAPGQGLEWMGWINPKSGDTASAQRFQGRVTMSGDTATSTVHMELTSLKSEDTAVYFCARPRWNGGAYYGLDVWGQGTAVTVSSASTKGPSVFPLAPCSRSTSESTAALGCLVKDYFPEPVTVS

SEQ ID NO: 795821 - protein, 209 aa, Homo sapiens
  misc_feature: NA.49.33.C11.G49C11.Sanger.heavy.1.sanger-aa
VGFGLSWVFLVAILKGVQCDVQVVESGGGLVQPGGSLTLSCIVSGFTVSNNYMSWVRQAPGKGLEWVSVIYSGGDTYYADSVKGRFTISRDGFKNTLYLQMNSLRAEDTAVYYCARDPPGIAVSGTYYWGQGTLVTVSSASTKGPSVFPLAPCSRSTSESTAALGCLVKDYFPEPVTVSWNSGALTSGVHTFPAVLQSSGLYSLSSVVT

SEQ ID NO: 795822 - protein, 184 aa, Homo sapiens
  misc_feature: NA.49.62.F07.G49F7.Sanger.heavy.1.sanger-aa
  MOD_RES (184)..(184): Any amino acid
MDWTWRFLFVVAAATGAQSRVQLVQSGAEVRKPGSSVKVSCKASGDTFNNFAVSWVRQAPGQGLEWVGRITPILNIANYAQTFHDRVTLIADKSTNTAYMELRSLGSADTAVYFCAREMSFYDSTSHYALDIWGQGTMVTVSSASTKGPSVFPLAPSSKSTSGGTAALGCLVKDYFPEPVTVSX

SEQ ID NO: 795823 - protein, 184 aa, Homo sapiens
  misc_feature: NA.49.62.F07.G49F7-2.Sanger.heavy.1.sanger-aa
MDWTWRFLFVVAAATGAQSRVQLVQSGAEVRKPGSSVKVSCKASGDTFNNFAVSWVRQAPGQGLEWVGRITPILNIANYAQTFHDRVTLIADKSTNTAYMELRSLGSADTAVYFCAREMSFYDSTSHYALDIWGQGTMVTVSSASTKGPSVFPLAPSSKSTSGGTAALGCLVKDYFPEPVTVSW

SEQ ID NO: 795824 - protein, 186 aa, Homo sapiens
  misc_feature: NA.49.9.A09.G49A9.Sanger.heavy.1.sanger-aa
MEFGLTWVFLVAILKGVQCEGQLVESGGGLVQPGGSLRLSCAASGIAFNKFWMYWVRQVPGKGLMWVSRIDVDGSYSDHADSVKGRFTVSRENAKNTVYLQMTGLRAEDTAVYYCARGLWSTVDLDWYFDLWGRGTLVTVSSASTKGPSVFPLAPSSKSTSGGTAALGCLVKDYFPEPVTVSWNSG

SEQ ID NO: 795825 - protein, 184 aa, Homo sapiens
  misc_feature: NA.51.12.B01.G51B1.Sanger.heavy.1.sanger-aa
MDWTWRILFLVAAATRAHSQVQVVQSGAEVKKPGASVKVSCKTSGYTFSGNNVHWVRQAPGQGLEWMGWFSLRTGAANYAQEFRGRVIMTGDTSIATTYMELTSLTFDDTAVYYCATEAADRGSLTGSRLSPRVLDYWGQGTLIIVSSASTKGPSVFPLAPSSKSTSGGTAALGCLVKDYFPEP

SEQ ID NO: 795826 - protein, 179 aa, Homo sapiens
  misc_feature: NA.51.30.C08.G51C8.Sanger.heavy.1.sanger-aa
MEFGLSWVFLVALLRGVQCHVQLIQSGGGVVQPGRSLRLSCAASGFVSSVYPMHWVRQAPGKGLEWVALISSDGRSESYADSVKGRFTISRDNSKNTLYLQMNSLRREDTAVYYCATEMSYYDASGLVPFDPWGQGTLVTVSSASTKGPSVFPLAPCSRSTSGGTAALGCLVKDYFPAP

SEQ ID NO: 795827 - protein, 178 aa, Homo sapiens
  misc_feature: NA.51.37.D04.G51D41.Sanger.heavy.1.sanger-aa
MEFGLSWVFLVATIEGVQCQVQLVESGGGLVKPGGSLRLSCAASGFTFSGYFMSWIRQAPGKGLQWVSHISANGRTTFYADSVKGRFSISRDNAKNSLYLQMNSLRAEDTAVYFCASVGEDYGDTEPFSYYFGVDVWGQGTTVTVSSASTKGPSVFPLAPSSKSTSGGTAALGCLVKD

SEQ ID NO: 795828 - protein, 179 aa, Homo sapiens
  misc_feature: NA.51.40.D07.G51D7.Sanger.heavy.1.sanger-aa
MEFGLSWVFLVALLRGVQCQVQLVESGGGVVQPGRSLRLSCVVSGFTFRVYDMHWVRQAPGKGLEWVAFISHDGSKTYYAESVKGRFTISRDNSKNTLFLHMKSLRAEDTAVYYCANLITEDNGNPRPLGTDVWGQGTTVTVSSASTKGPSVFPLAPSSKSTSGGTAALGCLVKDYFPE

SEQ ID NO: 795829 - protein, 181 aa, Homo sapiens
  misc_feature: NA.51.41.D08.G51D8.Sanger.heavy.1.sanger-aa
MEFGLSWVFLVAILKGVQCEVQLVESGGGLVQPGRSLRLSCTASGFTFGDYAMSWVRQAPGKGLEWVGFFRGKAYGGTTEYAASVIGRFTISRDDSKSIAYLHMSSLKTEDTAVYFCTRVFLYYYDTSGYSGVGHGMDVWGQGTTVTVSSASTKGPSVFPLAPSSKSTSGGTAALGCLVKD

SEQ ID NO: 795830 - protein, 181 aa, Homo sapiens; identical to SEQ ID NO: 795829
  misc_feature: NA.51.41.D08.G51D8-2.Sanger.heavy.1.sanger-aa

SEQ ID NO: 795831 - protein, 200 aa, Homo sapiens
  misc_feature: NA.51.5.A05.G51A5.Sanger.heavy.1.sanger-aa
MDLLHKNMKHLWFFLLLVAAPRWVLSQVQLRQWGAGLLKPSETLSLSCAVYRGSFSGYYWSWIRQSPGKGLEWIGRINHSGDTDYNPSLMSRVTMSVDSSKSEFSLRLTSLSVADTGVYFCARLPGPAPRVAPIWFTGTQNQGKSYDGLDVWGQGTTVTVSSASTKGPSVFPLAPSSKSTSGGTAALGCLVKDYFPEPVT

SEQ ID NO: 795832 - protein, 184 aa, Homo sapiens
  misc_feature: NA.51.52.E08.G51E8.Sanger.heavy.1.sanger-aa
MDWTWRILFLVAATTGAHSQVQLVQSGTEVKKPGASVKVSCKTSGYTFTDYYMHWVRQAPGQGLEWMGWIDPKNGATNYAQTFQGWVTMTSDTSSNTVYMELTSLTDTAVYFCVRDFRTIQRPLWSRHGNVKNDHVFGMDVWGQGTTVSVSPASTKGPSVFPLAPSSKSTSGGTAALGCLVKDY

SEQ ID NO: 795833 - protein, 180 aa, Homo sapiens
  misc_feature: NA.51.76.G10.G51G10.Sanger.heavy.1.sanger-aa
MEFGLSWVFLVALLRGVQCQVQLVESGGGVVQPGRSLRLSCAASGFTFSAYGMHWVRQAPGKGLEWVAFISDDGSNKEYAVSVKGRFTISRDNSQNTLYLQMNRLRAEDTAVYFCAKRYEWELGVEYGMDVWGQGTTVTVSSASTKGPSVFPLAPSSKSTSGGTAALGCLVKDYFPEPVT

SEQ ID NO: 795834 - protein, 179 aa, Homo sapiens
  misc_feature: NA.51.77.G11.G51G11.Sanger.heavy.1.sanger-aa
MEFGLTWVFLVALLRGVQCQVQLVESGGGVVQPGRSLRLSCAASGFTFRVYDMHWVRQAPGKGLEWVAVISYDGSKIFYVDSVKGRFIISRDNSQNTLFLQMHSLRPEDTAVYYCANLITEDNGDPRPLGVEVWGQGTTVIVSSASTKGPSVFPLAPSSKSTSGGTAALGCLVKDYFPE

SEQ ID NO: 795835 - protein, 177 aa, Homo sapiens
  misc_feature: NA.51.78.H01.G51H1.Sanger.heavy.1.sanger-aa
MELGLSWIFLLAILKGVQCEVLLVESGGGLVQPGRSLRLSCAASGFTFDDYAMHWVRQAPGKGLEWVSRISWNSGSIAYADSVRGRFTISRDNAKNSLYLQMNSLRAEDTALYYCAKAKATAGTQLDYWGQGTLVTVSSASTKGPSVFPLAPSSKSTSGGTAALGCLVKDYFPEPVT

SEQ ID NO: 795836 - protein, 181 aa, Homo sapiens
  misc_feature: NA.52.2.A02.G52A2.Sanger.heavy.1.sanger-aa
MEFGLSWVFLVALLRGVQCQVQVVESGGGVVQPGRSLRLSCAASGFTFRVYDMHWVRQAPGKGLEWVAVISYDGSKIYYVDSVKGRFIISRDNSENTLYLQMNSLRAEDTAVYYCANLITEDNGGPRPLGAEVWGQGTTVTVSSASTKGPSVFPLAPSSKSTSGGTAALGCLVKDYFPEPV

SEQ ID NO: 795837 - protein, 182 aa, Homo sapiens
  misc_feature: NA.52.37.D04.G52D4.Sanger.heavy.1.sanger-aa
MEFGQSWVLLVVLLRGVQCQVQLVESGGGVVQPGRSLRLSCAGSAFPFNNYAIDWVRQAPGKGLEWVAVISADGGTKYYADSARGRFTISRDNSQDMIYLQMNSLRPEDTAVYYCASGGSAWPRDAFDFWGQGTFVTVSSASTKGPSVFPLAPSSKSTSGGTAALGCLVKDYFPEPVTVSWN

SEQ ID NO: 795838 - protein, 178 aa, Homo sapiens
  misc_feature: NA.52.81.H04.G52H4.Sanger.heavy.1.sanger-aa
MEFGLSWLFLVAILKGVQCEVQLLQSGGGLVQPGGSLRLSCAASGFTFRVYDMSWVRQAPGMGLEWVSGINSGGSTYYADSVKGRFTISRDNSKNTLYLQMNSLRAEDTATYFCTKEYTQLDEEPNGDYFFDYWGQGTLVTVSSASTKGPSVFPLAPSSKSTSGGTAALGCLVKDYFP

SEQ ID NO: 795839 - protein, 187 aa, Homo sapiens
  misc_feature: NA.53.73.G07.G53G7.Sanger.heavy.1.sanger-aa
MDWTWRVFCLLAVAPGARSQVQLVQSGAEMKKPGASVMISCTTSGYTFTDSLIHWVRQAPGQGLEWMGLINPSGGSTSYSQRMQGRITMTRDTSTSTVYMEVSSLRSEDTAMYYCAILVDYDYNILSAQRDFDTWGQGTLVTVSSASTKGPSVFPLAPSSKSTSGGTAALGCLVKDYFPEPVTVSWN

SEQ ID NO: 795840 - protein, 195 aa, Homo sapiens
  misc_feature: NA.17.25.C03.K17C3.Sanger.light.1.sanger-aa
  MOD_RES (179)..(179): Any amino acid
  MOD_RES (188)..(188): Any amino acid
MDMRVPAQLLGLLLLWLRAARCDIQMTQSPSSLSASVGVRVTITCRTSHGVKTYLNWYQQKPGKAPDLLISGASTLRSGVPSRFSGSGSGTDFNLTITTPQPEDCAIYYCQQSYSSPRTFGQGTKVEIKRTVAAPSVFIFPPSDEQLKSGTASVVCLLNNFYPREAKVQWKVDNALQSXNSQESVTEXTARTQPT

SEQ ID NO: 795841 - protein, 193 aa, Homo sapiens
  misc_feature: NA.3.70.G04.K3G4.Sanger.light.1.sanger-aa
  MOD_RES (185)..(185): Any amino acid
MEAPAQLLFLLLLWLPDNTGQTVLTQSPATLSLSPGETATLSCRASQSVRGHLAWYQQKPGQPPSLLIYGAHNRATGIPARFSGSGSGTDFTLIISRLEPEDFAVYYCQQGYFWPTFGPGTKVDIKRTVAAPSVFIFPPSDEQLKSGTASVVCLLNNFYPREAKVQWKVDNALQSGNSQESVTEXTARTQPTL

SEQ ID NO: 795842 - protein, 194 aa, Homo sapiens
  misc_feature: NA.4.26.C04.K4C4.Sanger.light.1.sanger-aa
  MOD_RES (170)..(170): Any amino acid
MRLPAQLLGLLMLWVSGSSGDIVMTQSPLSLPVTPGEPASISCRSSQSLLHSNGDNYLDWYLQKPGQSPQLIIYLGSNRASGVPDRFSGSGSGTDFTLKISRVEAEDVGLYYCMQALQVPLTFGGGTKVEIKRTVAAPSVFIFPPSDEQLKSGTASVVCLLNNFYPREAXVQWKVDNALQSGNSQESVTEQTAR

SEQ ID NO: 795843 - protein, 189 aa, Homo sapiens
  misc_feature: NA.8.33.C11.K8C11.Sanger.light.1.sanger-aa
  MOD_RES (173)..(173): Any amino acid
  MOD_RES (180)..(180): Any amino acid
MEAPAQLLFLLLLWLPVSDTTGEIVLTQSPATLSLSPGERATLSCRASQNVGAFVSWYQHKPGQAPRPLIYGASNRATGIPARFSGSGYGTDFTLTIISLEPEDVAVYYCQHRTEWPPGATFGPGTKVEIKRTVAAPSVFIFPPSDEQLKSGTASVVCLLNNFYPREAKVQWXWTTPSNXEFPGVGHRT

SEQ ID NO: 795844 - protein, 192 aa, Homo sapiens
  misc_feature: NA.8.38.D05.K8D5.Sanger.light.1.sanger-aa
  MOD_RES (179)..(179): Any amino acid
MEAPAQLLFLLLLWLPDTTGEIVLTQSPATLSLSPGERATLSCRASQSVTTQLAWYQHKPGQAPRPLIFDASIRATGIPARFSGSGSGTDFTLTISSLEPEDFAVYYCQHRTEWPPGATFGPGTKIEIKRTVAAPSVFIFPPSDEQLKSGTASVVCLLNNFYPREAKVQWKVDNALQSXNSQESVTEQDSKD

SEQ ID NO: 795845 - protein, 189 aa, Homo sapiens
  misc_feature: NA.8.42.D09.L8D9.Sanger.light.1.sanger-aa
MAWALLLLTLLTQGTGSWAQSALTQPPSASGSPGQSVTISCTGASSDYNYISWYQQHPGKAPKLMIFEVNKRPSGVPDRFSGSKSGNTASLTVSGLQTEDEADYYCSSYSGSNRVFGGGTKLTVLGQPKAAPSVTLFPPSSEELQANKATLVCLISDFYPGAVTVAWKADSSPVKGRSGNYNPFQTVKQ

SEQ ID NO: 795846 - protein, 191 aa, Homo sapiens
  misc_feature: NA.9.1.A01.L9A1.Sanger.light.1.sanger-aa
  MOD_RES (171)..(171): Any amino acid
MAWALLFLTLLTQGTGSWAQSALTQPASVSGSPGQSIAISCTGTNSDVGAYNYVSWYQQHPGKAPQLIISDVNNRPPGISDRFSGSKSGNTASLTISGLRAEDEAHYYCSSYTTSDTLLFGGGTELTVLGQPKAAPSVTLFPPSSEELQANKATLVCLISDFYPGAVTVAXKADSSPVKGRSGNYNPFQTV

SEQ ID NO: 795847 - protein, 179 aa, Homo sapiens
  misc_feature: NA.9.12.B01.L9B1.Sanger.light.1.sanger-aa
  MOD_RES (170)..(170): Any amino acid
MAWALLLLTLLTQGTGSWAQSALTQPPSASGSPGQSVTISCTGTSSDIGAYNYVSWYQQHPGKVPKLMIYEVNKRPSGVPDRFSGSKSGNTASLTVSGLQADDEADYYCSSYAGTHNVFGSGTTVTVLGQPKANPTVTLFPPSSEELQANKATLVCLISDFYPGAVTVAXKADSSPVKP

SEQ ID NO: 795848 - protein, 208 aa, Homo sapiens
  misc_feature: NA.9.31.C09.L9C9.Sanger.light.1.sanger-aa
MAWALLFLTLLTQGTGSWAQSALTQPASVSGSPGQSIAISCTGTNSDVGAYNYVSWYQQHPGKAPQLIISDVNNRPPGISDRFSGSKSGNTASLTISGLRAEDEAHYYCSSYTTSDTLLFGGGTELTVLGQPKAAPSVTLFPPSSEELQANKATLVCLISDFYPGAVTVAWKADSSPVKAGVETTTPSKQSNNKYAASSYLSLTPEQW

SEQ ID NO: 795849 - protein, 193 aa, Homo sapiens
  misc_feature: NA.10.1.A01.L10A1.Sanger.light.1.sanger-aa
MPWALLLLTLLTHSAVSVVQAGLTQPPSVSKDLRQTATLTCTGNNNNVGHDGVVWLQQHQGHPPKLLSDRNNIRPSGISERFSASRSGSTASLTITGLQADDEADYYCSAWDTGLSAWVFGGGTKLTVLGQPKAAPSVTLFPPSSEELQANKATLVCLISDFYPGAVTVAWKADSSPVKGRSGNYNPFQTVKQ

SEQ ID NO: 795850 - protein, 194 aa, Homo sapiens
  misc_feature: NA.10.35.D02.K10D2.Sanger.light.1.sanger-aa
  MOD_RES (166)..(166): Any amino acid
  MOD_RES (178)..(178): Any amino acid
METPAQLLFLLLLWLPETTGEVVLTQSPGTLSLSPGERATLSCRASHYVSDNYLAWLQHKPGQAPRLLIYAASIRATGIPGRFSGSGSGTDFTLTISRLEPEDFAVYYCQQYGHVPRTFGQGTKLEIKRTVAAPSVFIFPPSDEQLKSGTASVVCLLNNFYPREAXVQWKVDNALQSXNSQESVTEQDSKDSTY

SEQ ID NO: 795851 - protein, 190 aa, Homo sapiens
  misc_feature: NA.10.38.D05.L10D5.Sanger.light.1.sanger-aa
MAWALLLLTLLTQGTGSWAQSALTQPPSASGSPGQSVTISCTGTSSDFVAYNYVSWYQHHPGKAPKLLVFEVSKRPSGVPDRFSASKSGNTASLTVSGLQAEDEADYYCSAYSGPNRVFGGGTKVTVLGQPKAAPSVTLFPPSSEELQANKATLVCLISDFYPGAVTVAWKADSSPVKAGVETTTPSKQS

SEQ ID NO: 795852 - protein, 196 aa, Homo sapiens
  misc_feature: NA.10.53.E09.K10E9.Sanger.light.1.sanger-aa
MVLQTQVFISLLLWISGAYGDIVMTQSPDSLPVSLGERATINCKSSQSVLFSSDNKNYLAWYQQKPGQPPKLLIYWASTRESGVPDRFSGSGSGTDFTLTISSLQAEDAAVYYCQHYYSTPFTFGPGTKVEIKRTVAAPSVFIFPPSDEQLKSGTASVVCLLNNFYPREAKVQWKWTTPSNQEIPRSRSPNRTART

SEQ ID NO: 795853 - protein, 191 aa, Homo sapiens
  misc_feature: NA.10.6.A06.L10A6.Sanger.light.1.sanger-aa
MAWALLFLTLLTQGTGSWAQSALTQPASVSGSPGQSITISCTGTSSDVGGYNYVSWYQQHPGKAPKLIIHDVNNRPSGVSNRFSGFKSGNTASLTISGLQAEDEADYYCSSYTTSSTRVFGGGTKLTVLGQPKAAPSVTLFPPSSEELQANKATLVCLISDFYPGAVTVAWKADSSPVKAGVETTTPSKQS

SEQ ID NO: 795854 - protein, 194 aa, Homo sapiens
  misc_feature: NA.10.71.G05.K10G5.Sanger.light.1.sanger-aa
MEAPAQLLFLLLLWLPDTTGEIVLTQSPATLSLSPGERATLSCRASQSVRTSLGWYQHKSGQAPRLLIFDAFNRAPGVPGRFSGSGSGTDFTLTISSLEPEDFAVYYCQQRATFGGGATFGGGTKIEVKRTVAAPSVFIFPPSDEQLKSGTASVVCLLNNFYPREAKVQWKVDNALQSGNSQESVTEQDSKDST

SEQ ID NO: 795855 - protein, 151 aa, Homo sapiens
  misc_feature: NA.10.9.A09.K10A9.Sanger.light.1.sanger-aa
MEAPAQLLFLLLLWLPVSDTTGEIVLTQSPATLSLSPGERATLSCRASQNVGAFVSWYQHKPGQAPRPLIYGASNRATGIPARFSGSGYGTDFTLTIISLEPEDVAVYYCQHRTEWPPGATFGPGTKVEIKRTVAAPSVFIFPPSDEQLKS

SEQ ID NO: 795856 - protein, 188 aa, Homo sapiens
  misc_feature: NA.11.71.G05.K11G5.Sanger.light.1.sanger-aa
  MOD_RES (164)..(164): Any amino acid
MEAPAQLLFLLLLWLPDSTGEIVLTQSPATLSLSPGERATLSCRASQSVNSYLAWYQQKPGQTPRLLIYDASNRATGTPARFSGSGSGTDFTLTISSLEPEDFAVYYCQQRIDWITFGQGTRLEIKRTVAAPSVFIFPPSDEQLKSGTASVVCLLNNFYPREAXVQWKVDNALQSGNSQESVTEQDSK

SEQ ID NO: 795857 - protein, 189 aa, Homo sapiens
  misc_feature: NA.13.21.B10.L13B10.Sanger.light.1.sanger-aa
MAWIPLFLGVLAYCTGSVASYELTQPPSVSVSPGQTASITCSGDKLGDKYACWYQQKPGQSPVLVIYQDTKRPSGIPERFSGSNSGNTATLTISGTQAVDEADYYCQAWDSSTASFGTGTKVTVLGQPKANPTVTLFPPSSEELQANKATLVCLISDFYPGAVTVAWKADSSPVKGRSGNYNPFQTVKQ

SEQ ID NO: 795858 - protein, 194 aa, Homo sapiens
  misc_feature: NA.22.29.C07.K22C7.Sanger.light.1.sanger-aa
  MOD_RES (177)..(177): Any amino acid
MEAPAQLLFLLLLWLPGASAEVVMTQSPGTLSVSPGERATLSCRASQSISNNLAWYQQRPGQAPRLLIYVASSRATGTPARFSGSGSGTEFTLTISSLQSEDFAVYYCQQYNYWPRTFGQGTKVEVKRTVAAPSVFIFPPSDEQLKSGTASVVCLLNNFYPREAKVQWKGGQRPPIXNSQESVTEQDSKDSTYS

SEQ ID NO: 795859 - protein, 179 aa, Homo sapiens
  misc_feature: NA.26.12.B01.K26B1.Sanger.light.1.sanger-aa
  MOD_RES (164)..(164): Any amino acid
MEAPAQLLFLLLLWLPDITGKIMMTQSPGTLSVSPGERVTLSCRASQSVSNNLAWYQQKPGQAPRLLISGASTRATGIPARFSGRGSGTEFTLTITSLQSEDFAVYYCQQYNYWLSFGGGTKLEINRTVAAPSVFIFPPSDEQLKSGTASVVCLLNNFYPREAXVQWKVDNALQSGIPR

SEQ ID NO: 795860 - protein, 177 aa, Homo sapiens
  misc_feature: NA.26.78.H01.K26H1.Sanger.light.1.sanger-aa
  MOD_RES (165)..(165): Any amino acid
  MOD_RES (177)..(177): Any amino acid
MEAPAQLLFLLLLWLPDSTGDIVLTQSPATLSLSPGERATLSCRASQSVGSYLAWYQQKPGQAPRLLIYDASNRATGIPARFSGSESGTDFTLTISSLEPEDFALYYCQQRSNWPLTFGGGTRVEIRRTVAAPSVFIFPPSDEQLKSGTASVVCLLNNFYPREAXVQWKGGQRPPIX

SEQ ID NO: 795861 - protein, 193 aa, Homo sapiens
  misc_feature: NA.47.2.A02.K47A2.Sanger.light.1.sanger-aa
MEAPAQLLFLLLLWLPETTGEIVMTQSPATLSVSPGERATISCRAGQSISINLAWYQQRPGQAPRLLIYDASTRATGFPARFSGSASGTEFTLTINSLQSEDFAVYYCQQYHNWPLTFGQGTRLEIKRTVAAPSVFIFPPSDEQLKSGTASVVCLLNNFYPREAKVQWKGGQRPPIRKFPGVGHRTGQQGLNL

SEQ ID NO: 795862 - protein, 181 aa, Homo sapiens
  misc_feature: NA.47.46.E02.K47E2.Sanger.light.1.sanger-aa
MEAPAQLLFLLLLWLPETTGEIVMTQSPATLSVSPGERATISCRAGQSISINLAWYQQRPGQAPRLLIYDASTRATGFPARFSGSASGTEFTLTINSLQSEDFAVYYCQQYHNWPLTFGQGTRLEIKRTVAAPSVFIFPPSDEQLKSGTASVVCLLNNFYPREAKVQWKGGQRPPIRKFPG

SEQ ID NO: 795863 - protein, 177 aa, Homo sapiens
  misc_feature: NA.47.64.F09.K47F9.Sanger.light.1.sanger-aa
MEAPAQLLFLLLLWLPDTIGEVVLTQSPATLSLSPGERATLSCRASQNIHSYLAWYQQKPGQAPRLLIYDASNRATGIPDRFSGSGSGTDFTLTISSLEPEDFGLYYCQQREFWPPLTFGGGTRVEIKRTVAAPSVFIFPPSDEQLKSGTASVVCLLNNFYPREAKVQWKVDNALQS

SEQ ID NO: 795864 - protein, 193 aa, Homo sapiens
  misc_feature: NA.49.28.C06.K49C6.Sanger.light.1.sanger-aa
MEAPAQLLFLLLLWLPETTGEIAMTQSPATLSVSPGERATLSCRASQSVSSNLAWYQQKPGQAPRLLIYGASTRATGIPARFSGSGSGTEFTLTISSLQSEDFAVYYCQQYNYWLVFGQGTKLEIKRTVAAPSVFIFPPSDEQLKSGTASVVCLLNNFYPREAKVQWKVDNALQSGNSQESVTEQDSKDSTYS

SEQ ID NO: 795865 - protein, 200 aa, Homo sapiens
  misc_feature: NA.49.33.C11.K49C11.Sanger.light.1.sanger-aa
  MOD_RES (167)..(167): Any amino acid
MDMRVPAQLLGLLLLWLSGARCVIQMTQSPSSLSASIGDRITITCRASRDISMYLNWYQQKPGTAPKLLILDASTLETGVPSRFSGSGSGTDFTFTISRLQPEDIATYYCQQYDRLPLTFGGGTKVEIKRTVAAPSVFIFPPSDEQLKSGTASVVCLLNNFYPREAXVQWKVDNALQSGNSQESVTEQTARTQPTLCHPL

SEQ ID NO: 795866 - protein, 197 aa, Homo sapiens
  misc_feature: NA.49.66.F11.K49F11.Sanger.light.1.sanger-aa
  MOD_RES (176)..(176): Any amino acid
MEAPAQLLFLLLLWLPDTTGEIVLTQSPVTLSMSPGERATLSCRASQNVGSYLAWYQQKPGQAPSLLIFDASRRAADIPARFSGSGFGTDFTLTISSLEPEDFAVYYCQQRTTGFTFGPGTRVDIKRTVAAPSVFIFPPSDEQLKSGTASVVCLLNNFYPREAKVQWKVDNALQSXNSQESVTEQDSKDSTYSLSST

SEQ ID NO: 795867 - protein, 196 aa, Homo sapiens
  misc_feature: NA.49.9.A09.L49A9.Sanger.light.1.sanger-aa
MAWTVLLLGLLSHCTDSVTSYVLTQPPSVSVAPGQTARFPCEGNNIGGKGVHWYQQKPGQAPVLVVHDDSDRPSGIPERFSGSKSGNTATLTVSRVEAGDEADYICQVWDSSSALPGVFGGGTKLTVVGQPKAAPSVTLFPPSSEELQANQATLVCLISDFYPGAVTVAWKADSSPVKAGVETTTPSKQSNNKYAA

SEQ ID NO: 795868 - protein, 195 aa, Homo sapiens
  misc_feature: NA.51.40.D07.K51D7.Sanger.light.1.sanger-aa
  MOD_RES (179)..(179): Any amino acid
MDMRVPAQLLGLLLLWLSGARCDIQMTQSPSSLSASVGDRVTITCQASEDISNYLNWYQQKPGQAPKLLIYDASNLETGVPSRFSGSGSGTDFTFTISSLHPEDLATYYCQQYDNLPLTFGGGTKVEIKRTVAAPSVFIFPPSDEQLKSGTASVVCLLNNFYPREAKVQWKVDNALQSXNSQESVTEQDSKDSTY

SEQ ID NO: 795869 - protein, 197 aa, Homo sapiens
  misc_feature: NA.51.41.D08.K51D8.Sanger.light.1.sanger-aa
  MOD_RES (188)..(188): Any amino acid
MDMRVPAQLLGLLLLWLRGARCDIQMTQSPSSLSASVGDRVTITCRASQSISSYLNWYQQKPGKAPKLLIYAASSLQSEVPSRFSGSGSGTDFTLTISSLQPEDFATYYCQQSYGTLLTFGGGTKVEIKRTVAAPSVFIFPPSDEQLKSGTASVVCLLNNFYPREAKVQWKVDNALQSGNSQESVTEXTARTQPTLC

SEQ ID NO: 795870 - protein, 197 aa, Homo sapiens
  misc_feature: NA.51.41.D08.K51D8-2.Sanger.light.1.sanger-aa
MDMRVPAQLLGLLLLWLRGARCDIQMTQSPSSLSASVGDRVTITCRASQSISSYLNWYQQKPGKAPKLLIYAASSLQSEVPSRFSGSGSGTDFTLTISSLQPEDFATYYCQQSYGTLLTFGGGTKVEIKRTVAAPSVFIFPPSDEQLKSGTASVVCLLNNFYPREAKVQWKVDNALQSGNSQESVTEQDSKDSTYSL

SEQ ID NO: 795871 - protein, 166 aa, Homo sapiens
  misc_feature: NA.51.53.E09.L51E9b.Sanger.light.1.sanger-aa
MAWALLFLTLLTQGTGSWAQSALTQPASVSGSPGQSITISCTGTTNDIGTYNSVSWYQQYPGKVPKLMIFEVSDRPAGVSHRFSGSKSGSTASLTISGLQAEDEADYYCSSYTNRNTWVFGGGTKLTVLRQPKAAPSVTLFPPSSEELQANKATLVCLISDFYPGR

SEQ ID NO: 795872 - protein, 195 aa, Homo sapiens
  misc_feature: NA.51.76.G10.K51G10.Sanger.light.1.sanger-aa
MEAPAQLLFLLLLWLPDTTGEVVMTQSPATLSVSPGERATLSCRASQSVSSDLAWYQQKPGQAPRLLIYDASTRATDIPARFSGSGSGTEFTLTISSLQSEDFAIYYCQQYNNWPPYTFGQGTKLEIKRTVAAPSVFIFPPSDEQLKSGTASVVCLLNNFYPREAKVQWKVDNALQSGNSQESVTEQDSKDSTYS

SEQ ID NO: 795873 - protein, 195 aa, Homo sapiens
  misc_feature: NA.51.78.H01.K51H1.Sanger.light.1.sanger-aa
MDMRVPAQLLGLLLLWLRGARCDIQMTQSPSSLSASVGDRVTITCRASQSISSYLNWYQQRPGKAPNLLIYDASNLESGVPSRFSGSGSGTDFTLTISSVRPEDFATYYCQQSYSTPQLTFGGGTKVEIKRTVAAPSVFIFPPSDEQLKSGTASVVCLLNNFYPREAKVQWKVDNALQSGNSQESVTEQDSKDST

SEQ ID NO: 795874 - protein, 190 aa, Homo sapiens
  misc_feature: NA.51.82.H05.L51H51.Sanger.light.1.sanger-aa
MAWIPLLLPLLILCTVSVASYELTQPYSVSVSPGQTARITCSGDVLGKKYARWFQQKAGQAPVLMIYKDTERPSGIPERFSGSSSGTTVTLTISGAQVDDEADYYCYSAADNNSGIFGGGTKLTVLGQPKAAPSVTLFPPSSEELQANKATLVCLISDFYPGAVTVAWKADSSPVKGRSGNYNPFQTVKQ

SEQ ID NO: 795875 - protein, 198 aa, Homo sapiens
  misc_feature: NA.52.2.A02.K52A2.Sanger.light.1.sanger-aa
  MOD_RES (167)..(167): Any amino acid
  MOD_RES (179)..(179): Any amino acid
MDMRVPAQLLGLLLLWLSGARCIIQMTQSPSSLSASIGDRITITCRASQDINMYLNWYQQKPGKAPKLLILDASNLETGVPSRFSGSGSGTDFTFTIARLQPEDIATYYCQQYDNLPLTFGGGTKVEIRRTVAAPSVFIFPPSDEQLKSGTASVVCLLNNFYPREAXVQWKVDNALQSXNSQESVTEQDSKDSTYSLS

SEQ ID NO: 795876 - protein, 190 aa, Homo sapiens
  misc_feature: NA.52.37.D04.L52D4.Sanger.light.1.sanger-aa
MAWALLFLTLLTQGTGSWAQSALTQPASVSGSPGQSITISCTGTSNDIGTYNSVSWYQQYPGKVPKLMIFEVSDRPAGVSHRFSGSKSGSTASLTISGLQAEDEADYYCSSYTNRNTWVFGGGTKLTVLRQPKAAPSVTLFPPSSEELQANKATLVCLISDFYPGAVTVAWKADSSPVKAGVETTTPSKQ

SEQ ID NO: 795877 - protein, 194 aa, Homo sapiens
  misc_feature: NA.52.76.G10.L52G10.Sanger.light.1.sanger-aa
MAWALLFLTLLTQGTGSWAQSALTQPASVSGSPGQSITISCTGTSNDVGTYNSVSWYQQYPGKVPKLMIFEVSDRPAGVSHRFSGSKSGSTASLTISGLQAEDEADYYCSSYTNRNTWVFGGGTKLTVLRQPKAAPSVTLFPPSSEELQANKATLVCLISDFYPGAVTVAWKADSSPVKAGVETTTPSKQSNNK

SEQ ID NO: 795878 - protein, 193 aa, Homo sapiens
  misc_feature: NA.53.65.F10.L53F10.Sanger.light.1.sanger-aa
MAWTVLLLGLLSHCTDSVTSYVLTQPTSVSVAPGQTASITCGGNHIGAKNVHWYQQKPGQAPVLVVYNGSGRPSWIPGRFSGSKSGNTATLTISRVEAGDEADYYCQVWDNSNGGNWVFGGGTKLTVLGQPKAAPSVTLFPPSSEELQANKATLVCLISDFYPGAVTVAWKADSSPVKAGVETTTPSKQSNNK

SEQ ID NO: 795879 - protein, 184 aa, Homo sapiens
  misc_feature: NA.44.12.B01.1.PacBio.heavy.1.pb-aa
MDLLCKNMKHLWFFLLLVAAPRWVLSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVGQFVTNYFDHWGQGTLVTVSSASTKGPSVFPLAPSSKSTSGGTAALGCLVKDYFLYTV

SEQ ID NO: 795880 - protein, 178 aa, Homo sapiens
  misc_feature: NA.44.19.B08.1.PacBio.heavy.1.pb-aa
MDTLCSTLLLLTIPSWGLSQITVKESGPTLVKPTQTLTLTCTVSGFSLVTPGEGVVWVRQPPGKALEWIALTYWNDDIRYSPSLTTRLTLTKDTSKNQVVLTLTNVDPVDTGTYFCAHFMTTMTTGFFEPWGQGIQVTVSSASTKGPSVFPLAPCSRSTSESTAALGCLVKDYFLYTV

SEQ ID NO: 795881 - protein, 165 aa, Homo sapiens
  misc_feature: NA.44.19.B08.2.PacBio.heavy.1.pb-aa
MEFGLSWVFLVALLRGVQCQVQLVESGGGVVQPGTSLRLSCVASGLSFSDSAMHWVRQAPGKGLEWVAVIWSDGSKEYYGNSVKGRFSVSRDNSKNTVYLQMNNLRAEDSALYYCTSPSFYWGQGALVTVSSASTKGPSVFPLAPCSRSTSESTAALGCLVKDYF

SEQ ID NO: 795882 - protein, 174 aa, Homo sapiens
  misc_feature: NA.44.21.B10.2.PacBio.heavy.1.pb-aa
MEFGLSWVFLVVILQGVQSEVQLVESGGDLVQPGGSLRLSCVASGFTISDHYMDWVRQAPGKGLEWLGRSKNKVASFITEYAASVKARFTLSRDDFKNSLILRMTNLKTEDTGMYYCVVFISGTVHWGQGTLVTVSSASTKGPSVFPLAPCSRSTSESTAALGCLVKDYFLYTV

SEQ ID NO: 795883 - protein, 172 aa, Homo sapiens
  misc_feature: NA.44.23.C01.1.PacBio.heavy.1.pb-aa
MKHLWFFLLLVAAPRWVLSQVQLQESGPGLVRPSGTLSLICTVSGVSISSDHSWGWIRQPPGRGMEWIGDIHYTGATYYSPSLKSRLTISRDTSMNRFSLKLTSVTAADTAVYFCARRDWSFNLWGRGTLVTVSSASTKGPSVFPLAPCSRSTSGGTAALGCLVKDYFLYTV

SEQ ID NO: 795884 - protein, 176 aa, Homo sapiens
  misc_feature: NA.44.27.C05.1.PacBio.heavy.1.pb-aa
MEFGLSWVFLVALLRGVMCQVQFVESGGGVAPVGGSLRLSCAASGFTFDNWNMQWVRQAPGEGLEWVAGVSFHGGNQVYGDSVEGRFTISRDNSENTVSLQMNSLRPQDTAVYFCARLSVSKIGSFDAWGQGTLVTVSSASTKGPSVFPLAPCSRSTSESTAALGCLVKDYFLYTV

SEQ ID NO: 795885 - protein, 183 aa, Homo sapiens
  misc_feature: NA.44.27.C05.2.PacBio.heavy.1.pb-aa
MEFGLSWVFLVALLRGVMCQVQFVESGGGVAPVGGSLRLSCAASGFTFDNWNMQWVRQAPGEGLEWVAGVSFHGGNQVYGDSVEGRFTISRDNSENTVSLQMNSLRPQDTAVYFCARLSVSKIGSFDAWGQGTLVTVSSASTKGPSVFPWRPAPGAPPRAQRPWAAWSRTTSYILSERAGKAH

SEQ ID NO: 795886 - protein, 182 aa, Homo sapiens
  misc_feature: NA.44.29.C07.1.PacBio.heavy.1.pb-aa
MDTLCSTLLLLTIPSWVLSQITLKESGPTLVKPTQTLTLTCNLSGFSLRSDGAIVGWVRQPPGKALEWLALIYWDDDRRYSPSLKSRLSITGDASNTQVILRVANMAPADTATYYCAHMINYYKSGGYVSGFDIWGQGTMVTVSSASTKGPSVFPLAPCSRSTSESTAALGCLVKDYFLYTV

SEQ ID NO: 795887 - protein, 183 aa, Homo sapiens
  misc_feature: NA.44.33.C11.1.PacBio.heavy.1.pb-aa
MEFGLTWVFLVALLRGVQCQVKLVESGGGVVQPGRSLRLSCVASGFTFNRHGMHWVRQAPGKGLEWVALIWYDGSNKYYVDSVKGRFTISRDNSKNTLYLEMNSLRAEDTAVYYCARDGARGYRYDMLYSNGMDAWGQGTTVAVSSASTKGPSVFPLAPSSKSTSGGTAALGCLVKDYFLYTV

SEQ ID NO: 795888 - protein, 180 aa, Homo sapiens
  misc_feature: NA.44.35.D02.1.PacBio.heavy.1.pb-aa
MKHLWFFLLLVAPPRWVVSEVQLQESGPGRVKPSETLSLTCNVSGGYISSYYWSWLRQSAGKGLEWIGRIYNSGSTNYNPALKSRVTMSLDRSKNQFSLKLTSVTAADTAVYYCARDSYRYSRDGGANWLDPWGQGTLVTVSSASTKGPSVFPLAPSSKSTSGGTAALGCLVKDYFLYTV

SEQ ID NO: 795889 - protein, 182 aa, Homo sapiens
  misc_feature: NA.44.38.D05.1.PacBio.heavy.1.pb-aa
VQVLGTWVFLVAILKGVQCEVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARAGAGVRGVAYYYYGMDVWGQGTTVTVSSASTKGPSVFPLAPCSRSTSGGTAALGCLVKDYFLYTV

SEQ ID NO: 795890 - protein, 184 aa, Homo sapiens
  misc_feature: NA.44.39.D06.1.PacBio.heavy.1.pb-aa
MEFGLSWVFLVALLRGVQCQEHLVESGGGVVQPGRSLRLSCVASGFSFDRFGLHWVRQAPGKGPEWVAVISDDGSEKYYSDSVKGRFTISRDNSKNMLYLQMNSVRVDDTSVYYCARGTSKETVRGIINYYYLMDVWGRGTSVTVSSASTKGPSVFPLAPCSRSTSGGTAALGCLVKDYFLYTV

SEQ ID NO: 795891 - protein, 169 aa, Homo sapiens
  misc_feature: NA.44.45.E01.1.PacBio.heavy.1.pb-aa
MEFGLSWVFLVALLRGVQCQVQLVESGGGVVQPGTSLRLSCVASGLSFSDSAMHWVRQAPGKGLEWVAVIWSDGSKEYYGNSVKGRFSVSRDNSKNTVYLQMNNLRAEDSALYYCTSPSFYWGQGALVTVSSASTKGPSVFPLAPCSRSTSESTAALGCLVKDYFLYTV

SEQ ID NO: 795892 - protein, 177 aa, Homo sapiens
  misc_feature: NA.44.55.E11.1.PacBio.heavy.1.pb-aa
MEFWLSWVLLVGLLKGVQCEVRLMESGGGLVQPGGSQRLSCAASGLTVSSNYMSWVRQAPGKGLEWVSVIYTGDFTYYADSVKGRFTISRDNSRNTVYLQMNNLRGDDTAVYYCARQVGARSGYYSFDFWGQGTLVTVASASTKGPSVFPLAPSSKSTSGGTAALGCLVKDYFLYTV

SEQ ID NO: 795893 - protein, 172 aa, Homo sapiens; identical to SEQ ID NO: 795883
  misc_feature: NA.44.57.F02.1.PacBio.heavy.1.pb-aa

SEQ ID NO: 795894 - protein, 179 aa, Homo sapiens
  misc_feature: NA.44.6.A06.1.PacBio.heavy.1.pb-aa
MDWTWRFLFVVAAATGVQSLVQLVQSGTRMPQPWSSVTLSCTASGSTTSSTTYTINWVRQAPGQGLEWMGGIIPLFGSLTYARDFRGRITITADKSTDTVSMTMSSLKSDDTAVYYCARGPYPSSHGAFEIWGQGTLVIVTSASTKGPSVFPLAPCSRSTSGGTAALGCLVKDYFLYTV

SEQ ID NO: 795895 - protein, 177 aa, Homo sapiens
  misc_feature: NA.44.62.F07.1.PacBio.heavy.1.pb-aa
MEFGLSCLFLVAFLKGVVCEVQLLESGGGLIRPGRSLTLSCAASGFTFSAYGMTWVRRAPGRGLEWVSSIGAGGVTFYGDSVKGRFTISRDNSQDKLFLQMKNLRPEDTGVYYCLKARTTVTPHDTFSTWGRGTVVTVSSASTKGPSVFPLAPCSRSTSESTAALGCLVKDYFLYTV

SEQ ID NO: 795896 - protein, 177 aa, Homo sapiens; identical to SEQ ID NO: 795892
  misc_feature: NA.44.67.G01.1.PacBio.heavy.1.pb-aa

SEQ ID NO: 795897 - protein, 177 aa, Homo sapiens
  misc_feature: NA.44.70.G04.1.PacBio.heavy.1.pb-aa
MEFGLSWVFLVALLRGVHCQVHLVESGGGVVQPGRSLRLSCEASGFSFSGSGMHWVRQAPGKGPEWLAVIAHDGSSEYYADSVKGRFTISRDNSRNIVYLEMVSLRVEDSALYYCARSGGGSSYYRAHDWGQGTLVTVSSASTKGPSVFPLAPCSRSTSESTAALGCLVKDYFLYTV

SEQ ID NO: 795898 - protein, 177 aa, Homo sapiens
  misc_feature: NA.44.71.G05.1.PacBio.heavy.1.pb-aa
MEFGLILIFLVVFLEGVQCEGRLAESGGGLAQPGRSLRLSCVVSGFSLSDYHLAWVRQAPGKGLEWITFVRMKRYGGSKEYAASVKGRFTVSRDDSNSVGHLQMSNLRPDDTGVYYCARRSWDVDAFDIWGQGTMVTVSSASTKGPSVFPLAPCSRSTSGGTAALGCLVKDYFLYTV

SEQ ID NO: 795899 - protein, 180 aa, Homo sapiens
  misc_feature: NA.44.71.G05.2.PacBio.heavy.1.pb-aa
MEFGLSWLFLVAVLKGVQCEVQLLESGGGLVQPGGSLTLSCAASGFAFNTYAMIWVRQAPGKGLEWVSSITGGSATNVADSVKGRFIVSRDNSKNTVFLQMKSLRVDDTALYYCARGSQKLQQYKYYYYMDVWGKGTPVTVSSASTKGPSVFPLAPSSKSTSGGTAALGCLVKDYFLYTV

SEQ ID NO: 795900 - protein, 173 aa, Homo sapiens
  misc_feature: NA.44.72.G06.1.PacBio.heavy.1.pb-aa
MELGLSWVFLVAILEGVQCEVQLVESGGGLVQPGGSLRLSCAASGFTFSSYWMNWVRQAPGKGLEWVAIMKKDGTETHYVDSVKGRFTISRDNAKNSLYLQMNSLRVEDTAVYYCAGGAGWLIDYWGQGTLVTVSSASTKGPSVFPLAPCSRSTSESTAALGCLVKDYFLYTV

SEQ ID NO: 795901 - protein, 177 aa, Homo sapiens
  misc_feature: NA.44.73.G07.1.PacBio.heavy.1.pb-aa
MEFGLSWVFLVTLLRGVQCQVHLVESGGGVVQPGRSLRLSCEASGFSFSSSGMHWVRQAPGKGPEWLAVIAYDGTSRYYADSVKGRFTISRDNSRNTLYLEMISLRGEDSALYYCARSGSGSSYYRAFHWGQGTLVTVSSASTKGPSVFPLAPCSRSTSESTAALGCLVKDYFLYTV

SEQ ID NO: 795902 - protein, 175 aa, Homo sapiens
  misc_feature: NA.44.73.G07.2.PacBio.heavy.1.pb-aa
MDFGLRWVFLVALLRGGQCQVQLVESGGGAAQPGNSLRLSCAASGFIFRTYAMHWVRQAPGKGLEWVAIISEDGIEEHYGDSEKGRFTVSRDNSRNTLHLQMYNLTSEDTAVYYCARAPSRRSPLDYWGQGTLVTVSSASTKGPSVFPLAPCSRSTSESTAALGCLVKDYFLYTV

SEQ ID NO: 795903 - protein, 179 aa, Homo sapiens; identical to SEQ ID NO: 795894
  misc_feature: NA.44.74.G08.1.PacBio.heavy.1.pb-aa

SEQ ID NO: 795904 - protein, 184 aa, Homo sapiens; identical to SEQ ID NO: 795879
  misc_feature: NA.44.81.H04.1.PacBio.heavy.1.pb-aa

SEQ ID NO: 795905 - protein, 182 aa, Homo sapiens
  misc_feature: NA.44.85.H08.1.PacBio.heavy.1.pb-aa
MEFGLSWVFLVALLRGVQCQVQLVESGGGVVQPGRSLRLSCAASGFTFSTYGMHWVRQAPGKGLEWVALIWYDGSNKYYADSVKGRFTISRDNSKNTLYLQMNSLRAEDTAVYYCARTYCSTTTCWDYYYGMDVWGQGTTVTVSSASTKGPSVFPLAPSSKSTSGGTAALGCLVKDYFLYTV

SEQ ID NO: 795906 - protein, 172 aa, Homo sapiens; identical to SEQ ID NO: 795883
  misc_feature: NA.44.86.H09.1.PacBio.heavy.1.pb-aa

SEQ ID NO: 795907 - protein, 183 aa, Homo sapiens; identical to SEQ ID NO: 795887
  misc_feature: NA.44.86.H09.2.PacBio.heavy.1.pb-aa

SEQ ID NO: 795908 - protein, 183 aa, Homo sapiens
  misc_feature: NA.44.9.A09.1.PacBio.heavy.1.pb-aa
MDFGLRWVFLVALLRGGQCQVQLVESGGGAAQPGNSLRLSCAASGFIFRTYAMHWVRQAPGKGLEWVAIISEDGIEEHYGDSEKGRFTVSRDNSRNTLHLQMYNLTSEDTAVYYCARAPSRRSPLDYWGQGTLVTVSSASTKGPSVFPLAPCSRSTSESTAALGCLVKDYFLYTVWSGLARRH

SEQ ID NO: 795909 - DNA, 650 bp, Homo sapiens
  misc_feature: NA.52.14.B03.G52B3-Flu38.Sanger.heavy.1.sanger
accggtgctcgatttagtgtgagtagtttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggttact

SEQ ID NO: 795910 - DNA, 650 bp, Homo sapiens
  misc_feature: NA.45.42.D09.G45D9-RA19.Sanger.heavy.1.sanger
ggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggaggcgtggtccagcctgggaggtccctgagactctcctgtgcagcctctggattcaccttcagctactatggcatgcactgggtccgccaggctccaggcaagggtctggagggggtggcacttatatcatatgatggaacttataagtactatccagactccgtgaagggccgattcaccatctccagagacaattccaagaacacgctgtatctgcaaatgaacagcctgagagctgaggacacggctgtctattactgtgcgaaagataccggaaattactatgataccactggtcaccgtgactactggggccagggaaccctggttaccgtctcctcagcttccaccaagggcccatcggtcttccccctggcgccctgctccaggagcacctctgggggcacagcggccctgggctgcctggtcaaggactacttccccgaaccggttactgt

SEQ ID NO: 795911 - DNA, 650 bp, Homo sapiens
  misc_feature: NA.15.67.G01.G15G1-S4.Sanger.heavy.1.sanger
acgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggtatgatgcttttgatatgtggggccaagggacagtggtcaccgtcacttcagcctccaccaagggcccatcggtcttccccctggcgccctgctccaggagcacctccgagagcacagcggccctgggctgcctggtcaaggactacttcc

SEQ ID NO: 795912 - DNA, 650 bp, Homo sapiens
  misc_feature: NA.4.19.B08.G4B8-S7.Sanger.heavy.1.sanger
cggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgtttattactgtgcgcgggatagaggctcatcgtggatacaactatggtttgattactggggccacggaaccctggtcaccgtctcttcagcttccaccaagggcccatcggtcttccccctggcgccctgctccaggagcacctctgggggcacagcggccctgggctgcctggtcaaggactacttccccgaaccggttactgtctcttgg

SEQ ID NO: 795913 - DNA, 650 bp, Homo sapiens
  misc_feature: NA.3.55.E11.G3E11-S6.Sanger.heavy.1.sanger
gctcgatttagcactcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatac

SEQ ID NO: 795914 - DNA, 650 bp, Homo sapiens
  misc_feature: NA.15.28.C06.G15C6-S3.Sanger.heavy.1.sanger
ggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattccggggccctca

SEQ ID NO: 795915 - DNA, 650 bp, Homo sapiens
  misc_feature: NA.15.34.D01.G15D1-S11.Sanger.heavy.1.sanger
ggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatctgggggaggcttggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggatactttctggggccaggggaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattc

SEQ ID NO: 795916 - DNA, 650 bp, Homo sapiens
  misc_feature: NA.4.39.D06.G4D6-S9.Sanger.heavy.1.sanger
gtgctcgatttagtgacatctcgcagttctttggggagctctgggagaggagccccagccctgagattcccacgtgtttccattcagtgatcagcactgaacacagaggactcgccatggagtttgggctgagctgggttttccttgttgctattttaaaaggtgtccaatgtgaggtgcaactggtggagtctgggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttccccctggcgccctgctccaggagcacctccgagagcacagcggccctgggctgcctggtcaaggactac

SEQ ID NO: 795917 - DNA, 650 bp, Homo sapiens
  misc_feature: NA.53.65.F10.G53F10-Flu35.Sanger.heavy.1.sanger
cggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaattaggggctgagtacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggt

SEQ ID NO: 795918 - DNA, 650 bp, Homo sapiens
  misc_feature: NA.52.73.G07.G52G7-Flu36.Sanger.heavy.1.sanger
cggtgctcgatttagtcactcgcacgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacggtaccaagttcaagtctaggcacccagacatatatctgtaacgtcaaccacagccaagcaacaccaaggt

SEQ ID NO: 795919 - DNA, 650 bp, Homo sapiens
  misc_feature: NA.51.26.C04.G51C4-Flu15.Sanger.heavy.1.sanger
cggtgctcgatttagtctagcgactttgggtttgggggctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctccaagagcacctctgggggcacagcggccctgggctgcctggtcaaggactacttccccgaaccg

SEQ ID NO: 795920 - DNA, 650 bp, Homo sapiens
  misc_feature: NA.51.53.E09.G51E9-Flu33.Sanger.heavy.1.sanger
cgtgctcgatttagagagagtgtgttgggtttgggctgagctggcttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacacgctctatctggaagtgaagagcctgagagtcgaggacacggccgtcttttattgtgtgaaggggcgtgggacttattcttcaggaccatattactttgacttctggggcccgggaattctggtcaccgtctcctcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtg

SEQ ID NO: 795921 - DNA, 650 bp, Homo sapiens
  misc_feature: NA.49.66.F11.G49F11-Flu23.Sanger.heavy.1.sanger
gctcgatttgtcacgcgagaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagatttgactactggagccagggagccctggtcaccgtctcctcagcctccaccaagggcccatcggtcttccccctggcaccctcctccaagagcacctctgggggcacagcggccctgggctgcctggtcaaggactacttccccgaaccggttactgtctcttggaattc

SEQ ID NO: 795922 - DNA, 650 bp, Homo sapiens
  misc_feature: NA.25.53.E09.G25E9-RA17.Sanger.heavy.1.sanger
cggtgctcgatttagagagagtgtgttgggtttggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccgattcaccatctccagagacaattcccggaacattgtgtacttggaaatggtcagcctgagagtcgaggactcggctctgtattactgtgcgagatcgggaggtggtagtagttattaccgggcgcatgactggggccaggggaccctggtcaccgtctcctcagcctccaccaagggcccatcggtcttccccctggcgccctgctccaggagcacctccgagagcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacggtaccaagttcaagtctaggcacccagacatatatctgtaacgtcaaccacaagccaagcaacacc

SEQ ID NO: 795923 - DNA, 650 bp, Homo sapiens
  misc_feature: NA.25.70.G04.G25G4-RA18.Sanger.heavy.1.sanger
cggtgctcgatttagtgtagtgtgggggaggcgtggtccagcctgggaggtccctgagactctcctgttcagcctctgggttcatgttcagttcctctactatacactgggtccgccagccccccggcaaggggctggagtgggtggctcttatctcatatgatggaaatgttaaatactacgccgactccgtgaagggccgattcgccgtctccagagacaactccaagaacacggtgtttctgcaactgaacggcctgagaaatgtggacacggctgtatattactgtgcgcgatttctctccctcgctgcccactctacaactgtctcatctgacgtctggggccagggagccctggtcaccgtctcctcagcttccaccaagggcccatcggtcttccccctggcgccctgctccaggagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacggtaccaagttcaagtctaggcacccagacatatatctgtaacgtcaaccacaagccaagcaacacc

SEQ ID NO: 795924 - DNA, 650 bp, Homo sapiens
  misc_feature: NA.26.78.H01.G26H1-RA5.Sanger.heavy.1.sanger
  modified_base (650)..(650): a, c, t, g, unknown or other
cggtgctcgatttagtgtgagtagtttgggtttgggggggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggcaccctcctccaagagcacctctgggggcacagcggccctgggctgcctggtcaaggactacttccccgaaccggttactgtctcttn

SEQ ID NO: 795925 - DNA, 541 bp, Homo sapiens
  misc_feature: NA.13.37.D04.G13D4-RA20.Sanger.heavy.1.sanger
gccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcggtgcttcagagttccggtttgtattccctgtcaagtgtcgtgacggtaccaagttcaagtctaggcacccagacatatatctgtaacgtcaaccacaagccaa

SEQ ID NO: 795926 - DNA, 650 bp, Homo sapiens
  misc_feature: NA.40.27.C05.G40C5-RA6.Sanger.heavy.1.sanger
gctcgatttagacgcgcgagaaggggaaaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacgcactgtctctgcaaatgaatagcctgagagttgaggacacggctgtctattactgtgcgagagctaagggacttactcatagatttgactactggagccagggagccctggtcaccgtctcctcagcctccaccaagggcccatcggtcttccccctggcaccctcctccaagagcacctctgggggcacagcggccctgggctgcctggtcaaggactacttccccgaaccggttactgtctcttgga

SEQ ID NO: 795927 - DNA, 650 bp, Homo sapiens
  misc_feature: NA.13.71.G05.G13G5-RA22.Sanger.heavy.1.sanger
gctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaactcagcctccaccaagggcccatcggtcttccccctggcgccctgctccaggagcacctccgagagcacagcggccctgggctgcctggtcaaggactacttccccgaaccggttactgtctcttggaattccggggccctcaccagtggtgtcca

SEQ ID NO: 795928 - DNA, 650 bp, Homo sapiens
  misc_feature: NA.26.39.D06.G26D6-RA16.Sanger.heavy.1.sanger
gtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtctgggggaggcttggtccagcctggagggtccgtgagagtctcctgtgcagcctctggattcatcttcagtgaccactacatggactgggtccgccaggctccagggaaggggctggagtgggttggccgtattagaaataaagctaagagttacaccacagaatacgccgcgtctgtgaaaggcagattcattatctcaagagatgattcaaagaactcactgtatctgcaaatgaacagcctgaaaaccgaggacacggccgtgtattactgtgctaggtcagactacggtgactctaacccctattactcctactactacatggccgtctggggcaaagggaccacggtcaccgtctcctcagcctccaccaagggcccatcggtcttccccctggcgccctgctccaggagcacctccgagagcacagcggccctgggctgcctggtcaaggac

SEQ ID NO: 795929 - DNA, 650 bp, Homo sapiens
  misc_feature: NA.9.33.C11.G9C11-LC10.Sanger.heavy.1.sanger
ggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccaggcaagggactggagtgggtggcacttatatggtatgatggaagtaataaatattatgtagattccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctggctgcctggtcaaggactactt

SEQ ID NO: 795930 - DNA, 650 bp, Homo sapiens
  misc_feature: NA.4.59.F04.G4F4-S10.Sanger.heavy.1.sanger
cggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggccagggaaccctggtcaccgtctcttcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccata

SEQ ID NO: 795931 - DNA, 650 bp, Homo sapiens
  misc_feature: NA.44.39.D06.G44D6-RA24.Sanger.heavy.1.sanger
gtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggcgccctgctccaggagcacctctgggggcacagcggccctgggctgcctggtcaaggactacttcc

SEQ ID NO: 795932 - DNA, 650 bp, Homo sapiens
  misc_feature: NA.4.26.C04.G4C4-S2.Sanger.heavy.1.sanger
cggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccccgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttccccctggcgccctgctccaggagcacctccgagaacacagcggccctgggctgcctggtcaaggactac

SEQ ID NO: 795933 - DNA, 650 bp, Homo sapiens
  misc_feature: NA.17.25.C03.G17C3-S5.Sanger.heavy.1.sanger
gaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggagccctggtcaccgtcacgtcagcttccaccaagggcccatccgtcttccccctggcgccctgctccaggagcacctccgagagcacagccgccctgggctgcctggtcaaggactacttccccgaaccggttactgtctcttggaattccggggccc

SEQ ID NO: 795934 - DNA, 650 bp, Homo sapiens
  misc_feature: NA.17.31.C09.G17C9-S13.Sanger.heavy.1.sanger
ggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttccccctggcaccctcctccaagagcacctctgggggcacagcggccctgggctgcctggtcaaggactacttccccgaaccggttactgtctcttggaa

SEQ ID NO: 795935 - DNA, 650 bp, Homo sapiens
  misc_feature: NA.17.28.C06.G17C6-S12.Sanger.heavy.1.sanger
ggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccgtctcctcagcctccaccaagggcccatccgtcttccccctggcgccctgctccaggagcacctccgagagcacagcggccctgggctgcctggtcaaggactacttccccgaaccggttactgtctcttgga

SEQ ID NO: 795936 - DNA, 650 bp, Homo sapiens
  misc_feature: NA.4.35.D02.G4D2-S8.Sanger.heavy.1.sanger
ggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccagccggggaagtccctgagactctcctgtgcagtgtccgcgtccaccttccgtcgttttggcattcactgggtccgccaggctccaggcaagggactggagtgggtggcggtcatatggtgggatggaagtaatgcattttatgcagactccgtgaagggccgactcaccatctccagaggcagctccaagaacaccttttatctgcaattgaaaaccgtgagactcgacgacacggctgtctattactgcgcggggtctgaagaacaggtcggggccgtctacggcatggacgcctggggccaagggaccatggtcaccgtctcctcagcctccaccaagggcccatcggtcttccccctggcaccctcctccaagagcacctctgggggcacagcggccctgggctgcctggtcaaggactacttccccgaaccggtta

SEQ ID NO: 795937 - DNA, 650 bp, Homo sapiens
  misc_feature: NA.51.6.A06.G51A6-Flu14.Sanger.heavy.1.sanger
cggtgctcgatttagatctactgacaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagcagccctcgaagaccagcatgatggttttgatgtctggggccaagggacaatggtcaccgtctcttcagcctccaccaagggcccatcggtcttccccctggcaccctcctccaagagcacctctgggggcacagcggccctgggctgcctggtcaaggactacttccccgaac

SEQ ID NO: 795938 - DNA, 650 bp, Homo sapiens
  misc_feature: NA.52.19.B08.G52B8-Flu30.Sanger.heavy.1.sanger
cggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttccccgaaccggtta

SEQ ID NO: 795939 - DNA, 650 bp, Homo sapiens
  misc_feature: NA.51.36.D03.G51D3-Flu43.Sanger.heavy.1.sanger
gctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagcttttgatatttggggccaaggcacgaaggtcaccgtctcatcagcctccaccaagggcccatcggtcttccccctggcaccctcctccaagagcacctctgggggcacagcggccctgggctgcctggtcaaggactacttccccgaaccggttactgtctcttggaattccggggccctcaccagtggtgtccatacctttcccgcg

SEQ ID NO: 795940 - DNA, 650 bp, Homo sapiens
  misc_feature: NA.51.35.D02.G51D2-Flu42.Sanger.heavy.1.sanger
ggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcc

SEQ ID NO: 795941 - DNA, 650 bp, Homo sapiens
  misc_feature: NA.49.11.A11.G49A11-Flu27.Sanger.heavy.1.sanger
gtgctcgatttagctacgactgcaagggaaaggggaggtctcagagaggagccttagccctggactccaaggcctttccacttggtgatcagcactgagcacagaggactcaccatggagttggggctgagctgggttttccttgttgctattttagaaggtgtccagtgtgaggtgcagctggtggactcggggggaggcttggtccagcctgggggttccctgagactctcctgtgtagtctctggattcagctttaggagttattacatgagttgggtccgccaggctccagggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttccccgaaccggttactgtctcttggaaattccgggg

SEQ ID NO: 795942 - DNA, 650 bp, Homo sapiens
  misc_feature: NA.26.12.B01.G26B1-RA3.Sanger.heavy.1.sanger
gaccggtgctcgatttagtgacatctcgcagttctttggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctcaagagccgagtcaccatatcaatggacacgtccaggaaccacctctccctgaacctcaactctgttacggccgcggacacggccgtgtattattgtgcgagggaggcccaaaatggtggcgactcgccttcacttgacctctggggccagggaaggctggtcatcgtctcctcagcctccaccaagggcccatcggtcttccccctggcgccctgctccaggagcacctccgagagcacagcggccctgggctgcctggtcaaggactacttccccgaaccggttactgtctcttggaattccggggccctcaccagtggtgt

SEQ ID NO: 795943 - DNA, 650 bp, Homo sapiens
  misc_feature: NA.44.27.C05.G44C5-RA23.Sanger.heavy.1.sanger
gctcgatttagacgcgatcgaagggtttggggcctgggagacgagcccagcactggaagtcgccggtgtttccactcggtgatcatcactgaacacagaggactcaccatggagtttgggctgagctgggttttcctcgttgccatcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtatttttgtgcgagactatctgtttccaaaatcggttcattcgacgcctggggccagggaaccctggtcaccgtctcctcggcctccaccaagggcccatcggtcttccccctggcgccctgctccaggagcacctccgagagcacagcggccctgggctgcctggtcaaggactacttccccgaaccggttactgtctcttggaa

SEQ ID NO: 795944 - DNA, 650 bp, Homo sapiens
  misc_feature: NA.13.55.E11.G13E11-RA21.Sanger.heavy.1.sanger
gctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttccgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttccccgaaccggttactgtctcttgga

SEQ ID NO: 795945 - DNA, 650 bp, Homo sapiens
  misc_feature: NA.22.29.C07.G22C7-RA2.Sanger.heavy.1.sanger
ggtgctcgatttagagtgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaaagggcccatcggtcttccccctggcgccctgctccagggagcacctccgagagcacagcggcccctgggctgcctggtcaaggactacttccccgaaccggttactgtctcttgga

SEQ ID NO: 795946 - DNA, 650 bp, Homo sapiens
  misc_feature: NA.40.39.D06.G40D6-RA15.Sanger.heavy.1.sanger
  modified_base (622)..(622): a, c, t, g, unknown or other
gtgctcgatttagtgacatctcgcagttctttggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctcaagagccgagtcaccatatcaatggacacgtccaggaaccacctctccctgaacctcaactctgttacggccgcggacacggccgtgtattattgtgcgagggaggcccaaaatggtggcgactcgccttcacttgacctctggggccagggaaggctggtcatcgtctcctcagcctccaccaagggcccatcggtcttccccctggcgccctgctccaggagcacctccgagagcacagcggccctgggctgcctggtcaaggactacttccccgaaccggttactgtctcttggaanttccggggccctcaccagtggtgtccat

SEQ ID NO: 795947 - DNA, 650 bp, Homo sapiens
  misc_feature: NA.15.28.C06.K15C6-S3.Sanger.light.1.sanger
  modified_base (588)..(588): a, c, t, g, unknown or other
ggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcanggaattcccaggagtcggtcaccgaacaggacagcaaggactcaacctactctctgtcatcc

SEQ ID NO: 795948 - DNA, 630 bp, Homo sapiens
  misc_feature: NA.40.27.C05.K40C5-RA6.Sanger.light.1.sanger
  modified_base (593)..(593): a, c, t, g, unknown or other
gctcgatttagacgcgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcatcttcccgccatctgatgagcagttgaaatctggaactgcctctgttgtgtgcctgctgaataacttctatccccgggaggctaaagtacagtggaaaggtggacaacgccctccaatcnggaaattcccaggagtcggtcaccgaacaggacagca

SEQ ID NO: 795949 - DNA, 650 bp, Homo sapiens
  misc_feature: NA.15.67.G01.K15G1-S4.Sanger.light.1.sanger
  modified_base (572)..(572): a, c, t, g, unknown or other
acgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccaggggaccaaggtggaaatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcaggaattcccaggagtcggtcaccgaacaggacagcaaggactcaa

SEQ ID NO: 795950 - DNA, 650 bp, Homo sapiens
  misc_feature: NA.4.26.C04.K4C4-S2.Sanger.light.1.sanger
  modified_base (578)..(578): a, c, t, g, unknown or other
cggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaag

SEQ ID NO: 795951 - DNA, 650 bp, Homo sapiens
  misc_feature: NA.3.70.G04.K3G4-S1.Sanger.light.1.sanger
  modified_base (561)..(561): a, c, t, g, unknown or other
cggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctactctct

SEQ ID NO: 795952 - DNA, 650 bp, Homo sapiens
  misc_feature: NA.3.55.E11.K3E11-S6.Sanger.light.1.sanger
  modified_base (558)..(558): a, c, t, g, unknown or other
  modified_base (592)..(592): a, c, t, g, unknown or other
gctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcanggaattcccaggagtcggtcaccgaacaggacagcaaggactcaacctactctctgtc

SEQ ID NO: 795953 - DNA, 650 bp, Homo sapiens
  misc_feature: NA.17.28.C06.L17C6-S12.Sanger.light.1.sanger
ggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccgccctcctctgaggagcttcaagccaacaaggccacactggtgtgcctgatcagtgacttctatcccggggcggtgaccgtggcttggaaggccgactcgagcccagtgaaaggccggagtggaaactacaaccccttccaa

SEQ ID NO: 795954 - DNA, 650 bp, Homo sapiens
  misc_feature: NA.4.35.D02.L4D2-S8.Sanger.light.1.sanger
ggtgctcgatttagcacacgaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtactttggtgttcggcggagggaccaagctgaccgtcctaggtcagcccaaggctgccccctcggtcactctgttcccgccctcctctgaggagcttcaagccaacaaggccacactggtgtgcctcatcagtgacttctatcccggggcggtgaccgtggcttggaaggccgactcgagcccagtgaaagccggagtggaaactacaaccccttccaaacagtcaaacaata

SEQ ID NO: 795955 - DNA, 650 bp, Homo sapiens
  misc_feature: NA.49.5.A05.K49A5-Flu31.Sanger.light.1.sanger
accggtgctcgatttagatctactgacaacacacaaggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaaccta

SEQ ID NO: 795956 - DNA, 650 bp, Homo sapiens
  misc_feature: NA.51.6.A06.L51A6-Flu14.Sanger.light.1.sanger
cggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctgttcccgccctcctctgaggagctccaagccaacaaggccacactagtgtgtctgatcagtgacttctatcccggggcggtgaccgtggcttggaaggccgactcgagcccagtgaaggccggagtggaaactacaaccccttccaaacagtcaaacaataaatacgccgct

SEQ ID NO: 795957 - DNA, 650 bp, Homo sapiens
  misc_feature: NA.49.62.F07.K49F7-Flu17.Sanger.light.1.sanger
cggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaacctactctctgtcatcc

SEQ ID NO: 795958 - DNA, 650 bp, Homo sapiens
  misc_feature: NA.52.6.A06.L52A6-Flu22.Sanger.light.1.sanger
  modified_base (615)..(615): a, c, t, g, unknown or other
cggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccgccctcctctgaggagcttcaagccaacaaggccacactagtgtgcctgatcagtgacttctatcccggggcggtgaccgtggcttggaaggccgactcgagcccagtgaangccggagtggaaactacaaccccttccaaacagtc

SEQ ID NO: 795959 - DNA, 650 bp, Homo sapiens
  misc_feature: NA.52.81.H04.L52H4-Flu46.Sanger.light.1.sanger
gaccggtgctcgatttagtagtgtagattcgcggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataattttgtgtcctggtaccagcaactcccaggcacagcccccaaactcctcatttatgacaatgataagcgaccctcagggatacctgaccgattctctggctccaagtctggcacgtcagccaccctgggcatcaccggactccagactggggacgaggccgattattactgcggaacatgggatagcagcctgagtgatgccagggtgttcggcggagggaccaagctgaccgtcctaggtcagcccaaggctgccccctcggtcactctgttcccgccctcctctgaggagcttcaagccaacaaggccacactggtgtgcctcatcagtgacttctatcccggggcggtgaccgtggcttggaaggccgactcgagcccagtgaaggccggagtggaaactacaacc

SEQ ID NO: 795960 - DNA, 650 bp, Homo sapiens
  misc_feature: NA.52.73.G07.L52G7-Flu36.Sanger.light.1.sanger
ggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcactctgttcccgccctcctctgaggagcttcaagccaacaaggccacactggtgtgcctcataagtgacttctatcccggggcggtgaccgtggcttggaaggccgactcgagcccagtgaaggccggagtggaaactacaaccccttccaaacagtca

SEQ ID NO: 795961 - DNA, 650 bp, Homo sapiens
  misc_feature: NA.51.35.D02.L51D2-Flu42.Sanger.light.1.sanger
ggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactctgttcccgccctcctctgaggagctccaagccaacaaggccacactagtgtgcctcatcagtgacttctatcccggggcggtgaccgtggcttggaaggccgactcgagcccagtgaaggccggagtggaaactacaaccccttccaaacagtcaaacaataaatacgccgcta

SEQ ID NO: 795962 - DNA, 650 bp, Homo sapiens
  misc_feature: NA.49.11.A11.L49A11-Flu27.Sanger.light.1.sanger
  modified_base (605)..(605): a, c, t, g, unknown or other
gtgctcgatttagctacgactgctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggagtttctggtcgcttctctggctccaagtctggcaactcggcctccctgaccatctcggggctccaggctgaggacgaggctacttattattgcatttcatacagagacaccaacagtctggtgttcggcggagggaccaagttgaccgtcctcggtcagcccaaggctgccccctcggtcactctgttcccgccctcctctgaggagcttcaggccaacgaggccacactggtgtgcctgatcagtgacttctatcccggggcggtgaccgtggcttggaaggccgactcgagcccagtgaangccggagtggaaactacaaccccttccaaacagtcaaacaataaa

SEQ ID NO: 795963 - DNA, 640 bp, Homo sapiens
  misc_feature: NA.40.67.G01.K40G1-RA7.Sanger.light.1.sanger
acgaccggtgctcgatttagatcacgtgcgtcgcgggggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatcttcccgccatctgatgagcagttgaaatctggaactgcctctgttgtgtgcctgctgaataacttctatccccgggaggctaaagtacagtggaaggtggacaacgccctccaatcagggaattcccaggagtcggtcaccgaacaggacagcaagga

SEQ ID NO: 795964 - DNA, 650 bp, Homo sapiens
  misc_feature: NA.41.2.A02.K41A2-RA9.Sanger.light.1.sanger
cggtgctcgatttagactcatctacggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatgagcagttgaaatctggaactgcctctgttgtgtgcctgctgaataacttctatccccgggaggctaaagtacagtggaaggtggacaacgccctccaatcagggaattcccaggagtcggtcaccgaacaggacagcaaggactcaacctactctctgtcat

SEQ ID NO: 795965 - DNA, 650 bp, Homo sapiens
  misc_feature: NA.25.70.G04.K25G4-RA18.Sanger.light.1.sanger
  modified_base (566)..(566): a, c, t, g, unknown or other
cggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcgagtcaggacattaccaattatttagcctggtatcaacacaaaccagggaaagtccctaagctcctgatctattctgcatccaccttgcagtcaggggtcccatctcgcttcagcggcagtggatctgggacagatttcagtctcaccatcaccggcctgcagcctgacgatcttgcaacttattactgtcaaaactatcacagtgccccgtacagttttggccaggggaccacagtggacctcaaaggaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctac

SEQ ID NO: 795966 - DNA, 650 bp, Homo sapiens
  misc_feature: NA.44.27.C05.L44C5-RA23.Sanger.light.1.sanger
gctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggcaacacggcctccctgacaatctctgggctccaggctgaggacgaggctgattattattgttgctcagatgttcgtcgcatcacttatgtcttcggaagtgggaccaaggtcaccgtcctaggtcagcccaaggccaaccccactgtcactctgttcccgccctcctctgaggagctccaagccaacaaggccacactggtgtgtctcatcagtgacttctatcccggggcggtgaccgtggcttggaaggccgactcgagcccagtgaaggccggagtggaaactacaaccccttccaaacagtcaaacaata

SEQ ID NO: 795967 - DNA, 650 bp, Homo sapiens
  misc_feature: NA.13.71.G05.L13G5-RA22.Sanger.light.1.sanger
gctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaaccccactgtcactctgttcccgccctcctctgaggagctccaagccaacaaggccacactggtgtgcctgatcagtgacttctatcccggggcggtgaccgtggcttggaaggccgactcgagcccagtgaaggccggagtggaaactacaaccccttccaaacagtcaaacaataaatacgccgctagcagct

SEQ ID NO: 795968 - DNA, 650 bp, Homo sapiens
  misc_feature: NA.25.39.D06.K25D6-RA16.Sanger.light.1.sanger
  modified_base (570)..(570): a, c, t, g, unknown or other
gtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagcccgcttcagtggcagtgggtctgggacagagtttactctcaccatctccagcctagagcctgaagattttgcagtttattactgtcagctccgcaagaagtggcctccaatattcactttcggccctgggaccaaagtggatatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaac

SEQ ID NO: 795969 - DNA, 650 bp, Homo sapiens
  misc_feature: NA.8.19.B08.K8B8-K8B8.Sanger.light.1.sanger
cggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcaggaaattcccaggagtcggtcaccgaacaggacagcaaggactcaacctactc

SEQ ID NO: 795970 - DNA, 650 bp, Homo sapiens
  misc_feature: NA.9.33.C11.K9C11-2-LC10.Sanger.light.1.sanger
ggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctggagcctgaagattttgcagtttattactgtcagcagcgtgccactttcggcggaggtgccactttcggcggagggaccaaaatagaggtcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcaggaattcccaggagtcggtcaccgaacaggacagcaaggactcaaccta

SEQ ID NO: 795971 - DNA, 650 bp, Homo sapiens
  misc_feature: NA.4.59.F04.L4F4-S10.Sanger.light.1.sanger
cggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgccccctcggtcactctgttcccaccctcctctgaggagcttcaagccaacaaggccacactggtgtgcctcatcagtgacttctatcccggggcggtgaccgtggcttggaaggccgactcgagcccagtgaaggccggagtggaaactacaaccccttccaaacagtcaaacaataaatacgcc

SEQ ID NO: 795972 - DNA, 650 bp, Homo sapiens
  misc_feature: NA.4.19.B08.L4B8-S7.Sanger.light.1.sanger
cggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcggtcactctgttcccgccctcctctgaggagcttcaagccaacaaggccacactggtgtgcctcatcagtgacttctatcccggggcggtgaccgtggcttggaaggccgactcgagcccagtgaaggccggagtggaaactacaaccccttccaaacagtcaa

SEQ ID NO: 795973 - DNA, 650 bp, Homo sapiens
  misc_feature: NA.17.25.C03.K17C3-S5.Sanger.light.1.sanger
  modified_base (566)..(566): a, c, t, g, unknown or other
gaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactccgcaacctgaggattgtgcaatctactactgtcaacagagttacagttcccctcgcacttttggccaggggaccaaagttgagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctac

SEQ ID NO: 795974 - DNA, 650 bp, Homo sapiens
  misc_feature: NA.17.31.C09.L17C9-S13.Sanger.light.1.sanger
ggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctctgaggagcttcaagccaacaaggccacactagtgtgcctgatcagtgacttctatcccggggcggtgaccgtggcttggaaggccgactcgagcccagtgaaggccggagtggaaactacaaccccttccaaacagtcaaacaataaatacgc

SEQ ID NO: 795975 - DNA, 650 bp, Homo sapiens
  misc_feature: NA.15.34.D01.L15D1-S11.Sanger.light.1.sanger
ggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttcccgccctcctctgaggagcttcaagccaacaaggccacactagtgtgcctcatcagtgacttctatcccggggcggtgaccgtggcttggaaggccgactcgagcccagtgaaagccggagtggaaactacaaccccttccaaacagtca

SEQ ID NO: 795976 - DNA, 610 bp, Homo sapiens
  misc_feature: NA.4.39.D06.L4D6-S9.Sanger.light.1.sanger
  modified_base (551)..(551): a, c, t, g, unknown or other
gtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcggtcactctgttcccgccctcctctgaggagcttcaagccaacaaggccacactagtgtgtctgatnagtgacttctatcccggggcggtgaccgtggcttggaaggccgactcgagcccagtgaa

SEQ ID NO: 795977 - DNA, 650 bp, Homo sapiens
  misc_feature: NA.51.37.D04.L51D4-Flu44.Sanger.light.1.sanger
ccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccgccctcctctgaggagcttcaagccaacaaggccacactggtgtgcctcatcagtgacttctatcccggggcggtgaccgtggcttggaaaggccgactcgagcccagtgaaaggccggagtggaaactacaaccccttccaaacagtc

SEQ ID NO: 795978 - DNA, 650 bp, Homo sapiens
  misc_feature: NA.51.77.G11.K51G11-Flu16.Sanger.light.1.sanger
  modified_base (567)..(567): a, c, t, g, unknown or other
cggtgctcgatttagctagtcactcaagggaaagggggcaggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaaccta

SEQ ID NO: 795979 - DNA, 650 bp, Homo sapiens
  misc_feature: NA.51.26.C04.L51C4-Flu15.Sanger.light.1.sanger
cggtgctcgatttagtctagcgactttgggtttgggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgttcccgccctcctctgaggagcttcaagccaacaaggccacactagtgtgcctgatcagtgacttctatcccggggcggtgaccgtggcttggaaggccgactcgagcccagtgaaaggccggagtggaaactacaaccccttccaaacagtcaaacaataaatacgccg

SEQ ID NO: 795980 - DNA, 650 bp, Homo sapiens
  misc_feature: NA.52.19.B08.L52B8-Flu30.Sanger.light.1.sanger
  modified_base (595)..(595): a, c, t, g, unknown or other
cggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccgccctcctctgaggagcttcaagccaacaaggccacactagtgtgcctgatcagtgacttctatcccggggcggtgaccgtggcttggaagncgactcgagcccagtgaaggccggagtggaaactacaaccccttccaaacagtca

SEQ ID NO: 795981 - DNA, 650 bp, Homo sapiens
  misc_feature: NA.51.36.D03.L51D3-Flu43.Sanger.light.1.sanger
gctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgttcccaccctcctctgaggagcttcaagccaacaaggccacactggtgtgcctcataagtgacttctatcccggggcggtgaccgtggcttggaaggccgactcgagcccagtgaaggccggagtggaaactacaaccccttccaaacagtcaaacaataaatacgccgc

SEQ ID NO: 795982 - DNA, 650 bp, Homo sapiens
  misc_feature: NA.52.14.B03.K52B3-Flu38.Sanger.light.1.sanger
  modified_base (563)..(563): a, c, t, g, unknown or other
ggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccaaggtggagatcaagcgaactgtggctgcaccatctgtcttcatcttcccgccatctgatgagcagttgaaatctggaactgcctctgttgtgtgcctgctgaataacttctatccccgggaggctaaggtacagtggaangtggacaacgccctccaatcagggaattcccaggagtcggtcaccgaacaggacagcaaggactcaacctactctctgtcatccact

SEQ ID NO: 795983 - DNA, 650 bp, Homo sapiens
  misc_feature: NA.51.30.C08.K51C8-Flu24.Sanger.light.1.sanger
  modified_base (558)..(558): a, c, t, g, unknown or other
ggtgctcgatttagtcactcatacaggggggaactgctcagttaggacccagacggaaccatggaagccccagcgcagcttctcttcctcctgctactctggctcccagataccactggagaagtagttatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctactctctgtc

SEQ ID NO: 795984 - DNA, 650 bp, Homo sapiens
  misc_feature: NA.51.52.E08.K51E8-Flu37.Sanger.light.1.sanger
  modified_base (565)..(565): a, c, t, g, unknown or other
gtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaagagtcaccctctcctgcagggccagccagagtgtcagcagcgacttagcctggtaccagcagaaacctggccaggctcccaggctcctcatctatggtgcttcctccagggccactggtatcccagccaggttcagtggcagtgggtctgggacagcgtttactctcaccatcaacagcctccagtctgaagattttgcagtttattactgtcaccagtataataagtggcctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgccctccaatcagggaattcccaggagtcggtcaccgaacaggacagcaaggactcaacctact

SEQ ID NO: 795985 - DNA, 547 bp, Homo sapiens
  misc_feature: NA.53.73.G07.K53G7-Flu39.Sanger.light.1.sanger
tgtgacatccagatgacccaatctccttctaccctgtctgcatctgtaggagacagagtcaccatcacttgccgggccagtcaaagtattagtgactggttggcctggtatcagcagaaaccggggaaagcccctaaggtcctgatctacagggcgtctagtctagaaagtggggtgccaccaaggttcagcggcagtggatctgggacagaattcactctcaccatcagcagcctgcagcctgatgattttgcaacttacttctgccaagaactgagtttttattggacgttcggccaagggacgaaggtggaaatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaacctactctctgtcatccactctcacactcagca

SEQ ID NO: 795986 - DNA, 650 bp, Homo sapiens
  misc_feature: NA.13.37.D04.L13D4-RA20.Sanger.light.1.sanger
ccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaaggctgccccctcggtcactctgttcccgccctcctctgaggagcttcaagccaacaaggccacactagtgtgcctcatcagtgacttctatcccggggcggtgaccgtggcttggaaggccgactcgagcccagtgaaaggccggagtggaaactacaaccccttccaaacagtcaaac

SEQ ID NO: 795987 - DNA, 650 bp, Homo sapiens
  misc_feature: NA.25.53.E09.K25E9-RA17.Sanger.light.1.sanger
cggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagcccgcttcagtggcagtgggtctgggacagagtttactctcaccatctccagcctagagcctgaagattttgcagtttattactgtcagctccgcaagaagtggcctccaatattcactttcggccctgggaccaaagtggatatcaaacgaactgtggctgcaccatctgtcttcatcttcccgccatctgatgagcagttgaaatctggaactgcctctgttgtgtgcctgctgaataacttctatccccgggaggctaaggtacagtggaaggtggacaacgccctccaatcagggaattcccaggagtcggtcaccgaacaggacagcaaggactcaacc

SEQ ID NO: 795988 - DNA, 593 bp, Homo sapiens
  misc_feature: NA.40.81.H04.K40H4-RA8.Sanger.light.1.sanger
  modified_base (557)..(557): a, c, t, g, unknown or other
gaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcatcttcccgccatctgatgagcagttgaaatctggaactgcctctgttgtgtgcctgctgaataacttctatccccgggaggctaangtacagtggaaaggtggacaacgccctccaatcagg

SEQ ID NO: 795989 - DNA, 650 bp, Homo sapiens
  misc_feature: NA.13.55.E11.L13E11-RA21.Sanger.light.1.sanger
gctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttcccgccctcctctgaggagctccaagccaacaaggccacactagtgtgcctcatcagtgacttctatcccggggcggtgaccgtggcttggaaggccgactcgagcccagtgaaggccggagtggaaactacaaccccttccaaacagtcaaacaat

SEQ ID NO: 795990 - DNA, 650 bp, Homo sapiens
  misc_feature: NA.45.42.D09.K45D9-RA19.Sanger.light.1.sanger
  modified_base (566)..(566): a, c, t, g, unknown or other
ggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaagagtcaccctctcctgcagggccagccagagtgtcagcagcgacttagcctggtaccagcagaaacctggccaggctcccaggctcctcatctatggtgcttcctccagggccactggtatcccagccaggttcagtggcagtgggtctgggacagcgtttactctcaccatcaacagcctccagtctgaagattttgcagtttattactgtcaccagtataataagtggcctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatccccgggaggctaangtacagtggaaggtggacaacgcccctccaatcagggaattcccaggagtcggtcaccgaacaggacagcaaggactcaaccta

SEQ ID NO: 795991 - DNA, 650 bp, Homo sapiens
  misc_feature: NA.44.39.D06.L44D6-RA24.Sanger.light.1.sanger
gtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcactgcctccaagtccggcaacacggcctccctgacaatctctgggctccaggctgaggacgaggctgattattattgttgctcagatgttcgtcgcatcacttatgtcttcggaagtgggaccaaggtcaccgtcctaggtcagcccaaggccaaccccactgtcactctgttcccgccctcctctgaggagctccaagccaacaaggccacactggtgtgcctgatcagtgacttctatcccggggcggtgaccgtggcttggaaggccgactcgagcccagtgaaagccggagtggaaactacaaccccttccaaacagtcaaac

SEQ ID NO: 795992 - protein, 177 aa, Homo sapiens
  misc_feature: NA.52.14.B03.G52B3-Flu38.Sanger.heavy.1.sanger-aa
MELGLSWIFLLAILKGVQCEVLLVESGGGLVQPGRSLRLSCAASGFTFDDYAMHWVRQAPGKGLEWVSRISWNSGSIAYADSVKGRFTISRDNAKNSLYLQMNSLRAEDTALYYCAKAKATAGTQLDYWGQGTLVTVSSASTKGPSVFPLAPSSKSTSGGTAALGCLVKDYFPEPVT

SEQ ID NO: 795993 - protein, 180 aa, Homo sapiens
  misc_feature: NA.45.42.D09.G45D9-RA19.Sanger.heavy.1.sanger-aa
MEFGLNWVFLVALLRGVQCQVHLVESGGGVVQPGRSLRLSCAASGFTFSYYGMHWVRQAPGKGLEGVALISYDGTYKYYPDSVKGRFTISRDNSKNTLYLQMNSLRAEDTAVYYCAKDTGNYYDTTGHRDYWGQGTLVTVSSASTKGPSVFPLAPCSRSTSGGTAALGCLVKDYFPEPVT

SEQ ID NO: 795994 - protein, 177 aa, Homo sapiens
  misc_feature: NA.15.67.G01.G15G1-S4.Sanger.heavy.1.sanger-aa
MELGLSWVFLVVILEGVQCEVHLVESGGGLVQPGGSLRLSCAVSGFTLRSYWMTWVRQAPGKGLEWVANINKDGSQKNYVDSVNGRFTISRDNAKNSLYLQMNSLRGEDTAVYYCARDDSRLYSSRWYDAFDMWGQGTVVTVTSASTKGPSVFPLAPCSRSTSESTAALGCLVKDYF

SEQ ID NO: 795995 - protein, 182 aa, Homo sapiens
  misc_feature: NA.4.19.B08.G4B8-S7.Sanger.heavy.1.sanger-aa
MEFGLSWVFLVVLLRGVQCQVKLVDSGGGVVQPGRSLRLSCIASGFTFGSYAMHWVRQAPGKGLEWVAAISYDGSDKYYIESVKGRFTISRDNRKNTLYLEMTSLRGDDTGVYYCARDRGSSWIQLWFDYWGHGTLVTVSSASTKGPSVFPLAPCSRSTSGGTAALGCLVKDYFPEPVTVSW

SEQ ID NO: 795996 - protein, 195 aa, Homo sapiens
  misc_feature: NA.3.55.E11.G3E11-S6.Sanger.heavy.1.sanger-aa
MEFGLSWVFLVALLRGVQCQVQLVESGGGVVQPGRSLRLSCAASGFTFSRYAMYWVRQAPGKGLEWVAVMSHDGRKKYYADSLKGRFTISRDNSNNTLYLQMNSLRTEDTAIYYCARDQSGRRNDYGGNLPDYWGQGTLVTVSSASTKGPSVFPLAPSSKSTSGGTAALGCLVKDYFPEPVTVSWNSGALTSGVH

SEQ ID NO: 795997 - protein, 178 aa, Homo sapiens
  misc_feature: NA.15.28.C06.G15C6-S3.Sanger.heavy.1.sanger-aa
MELGLSWVFLVAILEGVQCEVQLVESGGGLVQPGGSLRLSCEASGFTLSTYWMTWVRQAPGKGLEWVATIQKDGSDTTYVNSVMGRFTVSRDDAKNSLHLQMNNLRAEDTAVYYCVRDVLRWGQGTLVTVSSASTKGPSVFPLAPCSRSTSESTAALGCLVKDYFPEPVTVSWNSGAL

SEQ ID NO: 795998 - protein, 179 aa, Homo sapiens
  misc_feature: NA.15.34.D01.G15D1-S11.Sanger.heavy.1.sanger-aa
MELGLSWVFLVAILEGVQGEVQVVESGGGLVQPGGSLRLSCAASGFSSSKYWISWVRQAPGKGLEWMANMNQDGSDKHHVGSVQGRFTISRDNAKNLVYLQMNSLRADDTAVYYCAGGPEWYLDTFWGQGTLVTVSSASTKGPSVFPLAPCSRSTSESTAALGCLVKDYFPEPVTVSWN

SEQ ID NO: 795999 - protein, 178 aa, Homo sapiens
  misc_feature: NA.4.39.D06.G4D6-S9.Sanger.heavy.1.sanger-aa
MEFGLSWVFLVAILKGVQCEVQLVESGGSVVRPGGSLRLSCTASGFSFDDYGMSWVRQAPGKGLEWVSGMNWSGGSTAYADSVKGRFTISRDNAKNSLYLQLNSLRAEDTALYYCARTFRVCSGNSCYSSTGFDYWGQGALVTVSSASTKGPSVFPLAPCSRSTSESTAALGCLVKDY

SEQ ID NO: 796000 - protein, 178 aa, Homo sapiens
  misc_feature: NA.53.65.F10.G53F10-Flu35.Sanger.heavy.1.sanger-aa
MEFGLSWVFLVALLRGVQCQVHLVESGGGVVHPGGSLRLSCAASGFTFRVYGMHWVRQAPGKGLEWVALISDDGSDTYYGDSVKGRFTISRDNSRNTLYLQMNGLRAEDTAVYYCAKRFEWELGAEYGMDVWGQGTTVTVSSASTKGPSVFPLAPSSKSTSGGTAALGCLVKDYFPEP

SEQ ID NO: 796001 - protein, 181 aa, Homo sapiens
  misc_feature: NA.51.26.C04.G51C4-Flu15.Sanger.heavy.1.sanger-aa
MEFGLSWVFLVALLRGVQCQVHLVESGGGVVQPGRSLRLSCAASGFTFDNFNMHWVRRAPGKGLEWVAVITSDGGTTYYSDAVRGRFTISRDNSGNTLSLQMNSLRAEDRAVYYCVRSDLTGTGSYFLRNGMDVWGQGTTVTVSLASTKGPSVFPLAPSSKSTSGGTAALGCLVKDYFPEP

SEQ ID NO: 796002 - protein, 179 aa, Homo sapiens
  misc_feature: NA.26.78.H01.G26H1-RA5.Sanger.heavy.1.sanger-aa
MELGLSWIFLLAILKGVQCEVLLVESGGGLVQPGRSLRLSCAASGFTFDDYAMHWVRQAPGKGLEWVSRISWNSGSIAYADSVKGRFTISRDNAKNSLYLQMNSLRAEDTALYYCAKAKATAGTQLDYWGQGTLVTVSSASTKGPSVFPLAPSSKSTSGGTAALGCLVKDYFPEPVTVS

SEQ ID NO: 796003 - protein, 184 aa, Homo sapiens
  misc_feature: NA.13.71.G05.G13G5-RA22.Sanger.heavy.1.sanger-aa
MALGLNWVFLVAILEGVQCEVQLVESGGGLVQPGGSLRLSCQASGFSFSVYWMSWVRQTPGKGLEWVANINTDGSDPYYADSVKGRFTISRDNAKNSLYLQMDRLRDEDTAMYYCARDESGYSWGRGTLVTVNSASTKGPSVFPLAPCSRSTSESTAALGCLVKDYFPEPVTVSWNSGALTSGV

SEQ ID NO: 796004 - protein, 178 aa, Homo sapiens
  misc_feature: NA.26.39.D06.G26D6-RA16.Sanger.heavy.1.sanger-aa
MEFGLSWVFLVVIFPGVQSEVQLVESGGGLVQPGGSVRVSCAASGFIFSDHYMDWVRQAPGKGLEWVGRIRNKAKSYTTEYAASVKGRFIISRDDSKNSLYLQMNSLKTEDTAVYYCARSDYGDSNPYYSYYYMAVWGKGTTVTVSSASTKGPSVFPLAPCSRSTSESTAALGCLVKD

SEQ ID NO: 796005 - protein, 178 aa, Homo sapiens
  misc_feature: NA.9.33.C11.G9C11-LC10.Sanger.heavy.1.sanger-aa
MEFGLTWVFLVALLRGVQCQVKLVESGGGVVQPGRSLRLSCVASGFTFNRHGMHWVRQAPGKGLEWVALIWYDGSNKYYVDSVKGRFTISRDNSKNTLYLEMNSLRAEDTAVYYCARDGARGYRYDMLYSNGMDAWGQGTTVAVSSASTKGPSVFPLAPSSKSTSGGTAALAAWSRTT

SEQ ID NO: 796006 - protein, 190 aa, Homo sapiens
  misc_feature: NA.4.59.F04.G4F4-S10.Sanger.heavy.1.sanger-aa
MKHLWFFLLLEAAPRWVLSQVQLQESGPGLVKPSETLSLTCTVSGDSISSFFWSWIRQPPGKGLEWIGHISYSGSTNYNPSLKSRVTVSIDTSKNQFSLRLSSVTAADTAVYFCARSFDFWSGNPLGYWGQGTLVTVSSASTKGPSVFPLAPSSKSTSGGTAALGCLVKDYFPEPVTVSWNSGALTSGVH

SEQ ID NO: 796007 - protein, 180 aa, Homo sapiens
  misc_feature: NA.44.39.D06.G44D6-RA24.Sanger.heavy.1.sanger-aa
MEFGLSWVFLVALLRGVQCQEHLVESGGGVVQPGRSLRLSCVASGFSFDRFGLHWVRQAPGKGPEWVAVISDDGSEKYYSDSVKGRFTISRDNSKNMLYLQMNSVRVDDTSVYYCARGTSKETVRGIINYYYLMDVWGRGTSVTVSSASTKGPSVFPLAPCSRSTSGGTAALGCLVKDYF

SEQ ID NO: 796008 - protein, 178 aa, Homo sapiens
  misc_feature: NA.4.26.C04.G4C4-S2.Sanger.heavy.1.sanger-aa
MEFGLSWLFLVAILKGVQCEVQLVESGGGLVQPGGSPRLSCTDSGFTFSSHAMSWVRQAPGKGLEWVSAISGGGGGGTYYANSVRGRFTISRDNSKNTLYLQMNSLRADDTAVYYCAKCLIATERSSGWCNWLDPWGQGTHVTVSSASTKGPSVFPLAPCSRSTSENTAALGCLVKDY

SEQ ID NO: 796009 - protein, 187 aa, Homo sapiens
  misc_feature: NA.17.25.C03.G17C3-S5.Sanger.heavy.1.sanger-aa
MDWTWRILFLVAAATSAHSQVQLVQSGAEVKKPGASVKVSCKASGFTFTSYSINWVRQAAGQRPEWMGWANPNTGVTVSSPILRDRLTMTTNSSINTAYMELRSLTSDDTAVYYCARVPRSGEPTAAAFDFWGQGALVTVTSASTKGPSVFPLAPCSRSTSESTAALGCLVKDYFPEPVTVSWNSGA

SEQ ID NO: 796010 - protein, 184 aa, Homo sapiens
  misc_feature: NA.17.31.C09.G17C9-S13.Sanger.heavy.1.sanger-aa
MGSTAILTLLLAVLQGVCAEVQLVQSGAEVKKPGESLRISCKGSGYRFSSYWITWVRQKPGKGLEWMGRIDPSDSHINYSPSFQGHVTISADKSISTAFLQWRSLEASDTAIYYCASPVIAADHYYYYGLDVWGQGTTVTVSSPSTKGPSVFPLAPSSKSTSGGTAALGCLVKDYFPEPVTVSW

SEQ ID NO: 796011 - protein, 178 aa, Homo sapiens
  misc_feature: NA.17.28.C06.G17C6-S12.Sanger.heavy.1.sanger-aa
MELGLNWVFLVAVLEGVQCEVQLVESGGGLVQPGGSLRLSCAASGFPFSSYWMTWVRQTPGKGLEWVANIKQDGTAEFYVDSVKGRFTISRDNAKNSLYLQLNSLRVADTAVYYCARCGKSNGCVYWGQGALVTVSSASTKGPSVFPLAPCSRSTSESTAALGCLVKDYFPEPVTVSW

SEQ ID NO: 796012 - protein, 178 aa, Homo sapiens
  misc_feature: NA.4.35.D02.G4D2-S8.Sanger.heavy.1.sanger-aa
MEFGLRWVFLVALLRGVQCQMQLAESGGGVVQPGKSLRLSCAVSASTFRRFGIHWVRQAPGKGLEWVAVIWWDGSNAFYADSVKGRLTISRGSSKNTFYLQLKTVRLDDTAVYYCAGSEEQVGAVYGMDAWGQGTMVTVSSASTKGPSVFPLAPSSKSTSGGTAALGCLVKDYFPEPV

SEQ ID NO: 796013 - protein, 180 aa, Homo sapiens
  misc_feature: NA.51.6.A06.G51A6-Flu14.Sanger.heavy.1.sanger-aa
MEFGLSWVFLVALLRGVQCQVQLVQSGGGVVQPGRSLRLSCEASGFSFSTYGLRWVRQAPGKGLQWVASISYEGSNKYYADSVKGRFTISRDNPKNTLYLQMNTLRLEDTAVYYCARGRSITAALEDQHDGFDVWGQGTMVTVSSASTKGPSVFPLAPSSKSTSGGTAALGCLVKDYFPE

SEQ ID NO: 796014 - protein, 181 aa, Homo sapiens
  misc_feature: NA.52.19.B08.G52B8-Flu30.Sanger.heavy.1.sanger-aa
MEFGLSWVFLVALLRGVQCQVQLVESGGGVVQPGRSLRLSCAASGFTFRVYDMHWVRQAPGKGLEWVAFISYDGSKIYYVDSVKGRFIISRDNSENTLYLQMIRLRAEDTALYYCANLITEDNGDPRPLGAEVWGQGTTVIVSSASTKGPSVFPLAPSSKSTSGGTAALGCLVKDYFPEPV

SEQ ID NO: 796015 - protein, 206 aa, Homo sapiens
  misc_feature: NA.51.36.D03.G51D3-Flu43.Sanger.heavy.1.sanger-aa
GDLMCKKMKHLWFFLLLVAAPRWVLSQLHLQESGPGLVKPSETLSLTCSVSGGSISSRYYYWGWIRQPPGKGLDWIGSISYTGTTFFKSSLKSRVTMTADTSKDQFSLKLTSVTAADTALYFCARYNVGDSGAYYGAFDIWGQGTKVTVSSASTKGPSVFPLAPSSKSTSGGTAALGCLVKDYFPEPVTVSWNSGALTSGVHTFPA

SEQ ID NO: 796016 - protein, 198 aa, Homo sapiens
  misc_feature: NA.26.12.B01.G26B1-RA3.Sanger.heavy.1.sanger-aa
MDLLCKNMKHLWFFLLLVAAPRWVLSQLQLQESGPGLVKPSETLPLTCIVSGGSISSGTFYYSWSRQPPGKGLEWIGSVHHNGRTFYSPSLKSRVTISMDTSRNHLSLNLNSVTAADTAVYYCAREAQNGGDSPSLDLWGQGRLVIVSSASTKGPSVFPLAPCSRSTSESTAALGCLVKDYFPEPVTVSWNSGALTSG

SEQ ID NO: 796017 - protein, 180 aa, Homo sapiens
  misc_feature: NA.44.27.C05.G44C5-RA23.Sanger.heavy.1.sanger-aa
MEFGLSWVFLVAILRGVMCQVQFVESGGGVAPVGGSLRLSCAASGFTFDNWNMQWVRQAPGEGLEWVAGVSFHGGNQVYGDSVEGRFTISRDNSENTVSLQMNSLRPQDTAVYFCARLSVSKIGSFDAWGQGTLVTVSSASTKGPSVFPLAPCSRSTSESTAALGCLVKDYFPEPVTVSW

SEQ ID NO: 796018 - protein, 182 aa, Homo sapiens
  misc_feature: NA.13.55.E11.G13E11-RA21.Sanger.heavy.1.sanger-aa
MEFGLSWIFLAAILKGVQCEVHLVESGGGLVKPGGSLRLSCAASGITFSDAWMNWVRQAPGKGLEWIGRIKSEPDGGTTDYAAPVKGRFTISRDDSRNTVFPQMNSLTAGDTAVYYCASSSTWPLYFFDFWGQGTLATVSSASTKGPSVFPLAPCSRSTSGGTAALGCLVKDYFPEPVTVSW

SEQ ID NO: 796019 - protein, 184 aa, Homo sapiens
  misc_feature: NA.22.29.C07.G22C7-RA2.Sanger.heavy.1.sanger-aa
MEFGLNWVFLVALLRGVQCQVQLVESGGGVVQPGRSQRLSCAASGFTFSSYGMHWVRQTPGKGLEWVAVVSSEGSVQWYADAVKGRFTISRDNSRNTMYLDLNSLSPEDTGVYYCTKEGGTSGSSKYSFDVWGQGTLVTVSSASTKGPIGLPPGALLQGAPPRAQRPLGCLVKDYFPEPVTVSW

SEQ ID NO: 796020 - protein, 200 aa, Homo sapiens
  misc_feature: NA.40.39.D06.G40D6-RA15.Sanger.heavy.1.sanger-aa
  MOD_RES (191)..(191): Any amino acid
MDLLCKNMKHLWFFLLLVAAPRWVLSQLQLQESGPGLVKPSETLPLTCIVSGGSISSGTFYYSWSRQPPGKGLEWIGSVHHNGRTFYSPSLKSRVTISMDTSRNHLSLNLNSVTAADTAVYYCAREAQNGGDSPSLDLWGQGRLVIVSSASTKGPSVFPLAPCSRSTSESTAALGCLVKDYFPEPVTVSWXFRGPHQWCP

SEQ ID NO: 796021 - protein, 196 aa, Homo sapiens
  misc_feature: NA.15.28.C06.K15C6-S3.Sanger.light.1.sanger-aa
  MOD_RES (176)..(176): Any amino acid
MDMRVPAQLLGLLLLWLPGAKCDIQMTQSPSTLSASVGDRVTITCRASQSITKWLAWFQQKPGKAPKVLISAASTLQSGVPSRFSGSGSGTEFSLTISSLQPDDFATYYCQVHNNHFGGGTKVEIKRTVAAPSVFIFPPSDEQLKSGTASVVCLLNNFYPREAKVQWKVDNALQSXNSQESVTEQDSKDSTYSLSS

SEQ ID NO: 796022 - protein, 190 aa, Homo sapiens
  misc_feature: NA.40.27.C05.K40C5-RA6.Sanger.light.1.sanger-aa
  MOD_RES (179)..(179): Any amino acid
MDMRVPAQLLGLLLLWLRGARCDIQMTQSPSSLSASVGDRVTITCRASQSISSYLNWYQQKPGKAPRLLIYAASRLQSGVPSRFSGRGSGTDFTLTISSLQPEDFAIYYCQQSDNTPQTFGPGTRVDIKRTVAAPSVFIFPPSDEQLKSGTASVVCLLNNFYPREAKVQWKGGQRPPIXKFPGVGHRTGQ

SEQ ID NO: 796023 - protein, 193 aa, Homo sapiens
  misc_feature: NA.15.67.G01.K15G1-S4.Sanger.light.1.sanger-aa
  MOD_RES (167)..(167): Any amino acid
MDMRVPAQLLGLLLLWLPGARCAIQMTQSPSSLSASVGDRVTITCRASQDIRTDLGWYQQKSGKAPKLLICAASTLQSGVPSRFSGSGSGTDFTLTISSLQPEDFATYYCLQDYNYPRTFGQGTKVEIKRTVAAPSVFIFPPSDEQLKSGTASVVCLLNNFYPREAXVQWKVDNALQSGIPRSRSPNRTARTQ

SEQ ID NO: 796024 - protein, 194 aa, Homo sapiens
  misc_feature: NA.4.26.C04.K4C4-S2.Sanger.light.1.sanger-aa
  MOD_RES (170)..(170): Any amino acid
MRLPAQLLGLLMLWVSGSSGDIVMTQSPLSLPVTPGEPASISCRSSQSLLHSNGDNYLDWYLQKPGQSPQLIIYLGSNRASGVPDRFSGSGSGTDFTLKISRVEAEDVGLYYCMQALQVPLTFGGGTKVEIKRTVAAPSVFIFPPSDEQLKSGTASVVCLLNNFYPREAXVQWKVDNALQSGNSQESVTEQDSK

SEQ ID NO: 796025 - protein, 193 aa, Homo sapiens
  misc_feature: NA.3.70.G04.K3G4-S1.Sanger.light.1.sanger-aa
  MOD_RES (164)..(164): Any amino acid
MEAPAQLLFLLLLWLPDNTGQTVLTQSPATLSLSPGETATLSCRASQSVRGHLAWYQQKPGQPPSLLIYGAHNRATGIPARFSGSGSGTDFTLIISRLEPEDFAVYYCQQGYFWPTFGPGTKVDIKRTVAAPSVFIFPPSDEQLKSGTASVVCLLNNFYPREAXVQWKVDNALQSGNSQESVTEQDSKDSTYS

SEQ ID NO: 796026 - protein, 194 aa, Homo sapiens
  misc_feature: NA.3.55.E11.K3E11-S6.Sanger.light.1.sanger-aa
  MOD_RES (164)..(164): Any amino acid
  MOD_RES (176)..(176): Any amino acid
MEAPAQLLFLLLLWLPDATGEVVMTQSPATLSVSPGERATLSCRASQSISSNLAWYQQKPGQAPRLLIYAASTRATGIPARFSGSGSGTEFILTISSLQSEDFAIYYCQQYNNWWTFGQGTKVEIKRTVAAPSVFIFPPSDEQLKSGTASVVCLLNNFYPREAXVQWKVDNALQSXNSQESVTEQDSKDSTYSL

SEQ ID NO: 796027 - protein, 189 aa, Homo sapiens
  misc_feature: NA.17.28.C06.L17C6-S12.Sanger.light.1.sanger-aa
MAGFPLLLTLLTHCAGSWAQSVLTQPPSVSGTPGQRVTISCSGNSSGISTKHFCWYQQFPGSAPRLLIYRNDHRPSGVPDRFSGSMSGTSASLTISGLRSEDEADYYCAPWDDILNGPVFGGGTRLTVLSQPKAAPSVTLFPPSSEELQANKATLVCLISDFYPGAVTVAWKADSSPVKGRSGNYNPFQ

SEQ ID NO: 796028 - protein, 193 aa, Homo sapiens
  misc_feature: NA.4.35.D02.L4D2-S8.Sanger.light.1.sanger-aa
MAWALLLLTLLTQDTGSWAQSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTLVFGGGTKLTVLGQPKAAPSVTLFPPSSEELQANKATLVCLISDFYPGAVTVAWKADSSPVKAGVETTTPSKQSNN

SEQ ID NO: 796029 - protein, 194 aa, Homo sapiens
  misc_feature: NA.49.5.A05.K49A5-Flu31.Sanger.light.1.sanger-aa
MDMRVPAQLLGLLLLWLSGARCDIQMTQSPSSLSASVGDRVTFTCRASQDISNYLNWYQQKPGKAPKLLIYDASNLETGVPSRFSGSGSGTHFTFTISGLQPEDFATYYCQQYEDLPLTFGGGTKVEIRRTVAAPSVFIFPPSDEQLKSGTASVVCLLNNFYPREAKVQWKVDNALQSGNSQESVTEQDSKDST

SEQ ID NO: 796030 - protein, 194 aa, Homo sapiens
  misc_feature: NA.51.6.A06.L51A6-Flu14.Sanger.light.1.sanger-aa
MAWIPLLLPLLTLCTGSEASYVLTQPPSVSVSPGQTARITCSGDALPTHYSYWYQQKPGQAPVLLIYKDTERPSGIPERFSGSTSGTMVTLTISGVQAEDEADYFCQSSDISGTYVFGTGTKVTVLGQPKANPTVTLFPPSSEELQANKATLVCLISDFYPGAVTVAWKADSSPVKAGVETTTPSKQSNNKYAA

SEQ ID NO: 796031 - protein, 199 aa, Homo sapiens
  misc_feature: NA.49.62.F07.K49F7-Flu17.Sanger.light.1.sanger-aa
MDMRVPAQLLGLLLLWLSGARCDIRMTQSPSSLSASVGDRITITCQATQDISNYLNWYQQKPGKAPNLLIYDASNLEIGVPSRFSGSGSGTYFTFTIINLQPEDIATYYCQQYDNLPLTFGGGTTVEIKRTVAAPSVFIFPPSDEQLKSGTASVVCLLNNFYPREAKVQWKVDNALQSGNSQESVTEQDSKDSTYSLSS

SEQ ID NO: 796032 - protein, 190 aa, Homo sapiens
  misc_feature: NA.52.6.A06.L52A6-Flu22.Sanger.light.1.sanger-aa
  MOD_RES (179)..(179): Any amino acid
MAWALLFLTLLTQGTGSWAQSALTQPASVSGSPGQSITISCTGTGNDIGGYNYVSWYQHHPGKAPKLIIYGVGDRPSGVSNHFSGSKSGNTASLTISGLQAEDEADYYCASYTNNNNWVFGGGTKLTVLGQPKAAPSVTLFPPSSEELQANKATLVCLISDFYPGAVTVAWKADSSPVXAGVETTTPSKQ

SEQ ID NO: 796033 - protein, 187 aa, Homo sapiens
  misc_feature: NA.52.81.H04.L52H4-Flu46.Sanger.light.1.sanger-aa
MTCSPLLLTLLIHCTGSWAQSVLTQPPSVSAAPGQKVTISCSGSSSNIGNNFVSWYQQLPGTAPKLLIYDNDKRPSGIPDRFSGSKSGTSATLGITGLQTGDEADYYCGTWDSSLSDARVFGGGTKLTVLGQPKAAPSVTLFPPSSEELQANKATLVCLISDFYPGAVTVAWKADSSPVKAGVETTT

SEQ ID NO: 796034 - protein, 192 aa, Homo sapiens
  misc_feature: NA.52.73.G07.L52G7-Flu36.Sanger.light.1.sanger-aa
MAWALLLLTLLTQGTGSWAQSALTQPPSASGSPGQSVTISCTGSSSDVGAYDFVSWYQHHPGKAPKLIIFEVTKRPSGVPDRFSGSKSGNTASLTVSGLQAEDEADYYCTSYAGDNNLGVFGGGTKVTVLRQPKAAPSVTLFPPSSEELQANKATLVCLISDFYPGAVTVAWKADSSPVKAGVETTTPSKQS

SEQ ID NO: 796035 - protein, 190 aa, Homo sapiens
  misc_feature: NA.40.67.G01.K40G1-RA7.Sanger.light.1.sanger-aa
MEAPAQLLFLLLLWLPDATGQIVLTQSPVTLSLSPGERATLSCRASQSINSDLAWYQQKPGQAPRLLIYGASTRATGIPARFSGSGSGTDFALTISSLEPEDFAVYYCQQRNNWPPWTFGQGTKVEIKRTVAAPSVFIFPPSDEQLKSGTASVVCLLNNFYPREAKVQWKVDNALQSGNSQESVTEQDSK

SEQ ID NO: 796036 - protein, 198 aa, Homo sapiens
  misc_feature: NA.41.2.A02.K41A2-RA9.Sanger.light.1.sanger-aa
MDMRVPAQLLGLLLLWLSGARCIIQMTQSPSSLSASIGDRITITCRASQDINMYLNWYQQKPGKAPKLLILDASNLETGVPSRFSGSGSGTDFTFTIARLQPEDIATYYCQQYDNLPLTFGGGTKVEIRRTVAAPSVFIFPPSDEQLKSGTASVVCLLNNFYPREAKVQWKVDNALQSGNSQESVTEQDSKDSTYSLS

SEQ ID NO: 796037 - protein, 195 aa, Homo sapiens
  misc_feature: NA.25.70.G04.K25G4-RA18.Sanger.light.1.sanger-aa
  MOD_RES (167)..(167): Any amino acid
MDMRVPAQLLGLLLLWLPGTSCDIQMTQSPSFLSASVGDRVTITCRASQDITNYLAWYQHKPGKVPKLLIYSASTLQSGVPSRFSGSGSGTDFSLTITGLQPDDLATYYCQNYHSAPYSFGQGTTVDLKGTVAAPSVFIFPPSDEQLKSGTASVVCLLNNFYPREAXVQWKVDNALQSGNSQESVTEQDSKDSTY

SEQ ID NO: 796038 - protein, 193 aa, Homo sapiens
  misc_feature: NA.44.27.C05.L44C5-RA23.Sanger.light.1.sanger-aa
MAWALLLLTLLTQDTGSWAQSALTQPASVSGSPGQSVTISCTGASGNILSLNFVSWYQHHPGKAPKLIIYEAYKRPSGVSNRFTASKSGNTASLTISGLQAEDEADYYCCSDVRRITYVFGSGTKVTVLGQPKANPTVTLFPPSSEELQANKATLVCLISDFYPGAVTVAWKADSSPVKAGVETTTPSKQSNN

SEQ ID NO: 796039 - protein, 195 aa, Homo sapiens
  misc_feature: NA.13.71.G05.L13G5-RA22.Sanger.light.1.sanger-aa
MAWIPLFLGVLAYCTGSVASYELTQPPSVSVSPGQTASITCSGDKLGDKYACWYQQKPGQSPVLVIYQDTKRPSGIPERFSGSNSGNTATLTISGTQAVDEADYYCQAWDSSTASFGTGTKVTVLGQPKANPTVTLFPPSSEELQANKATLVCLISDFYPGAVTVAWKADSSPVKAGVETTTPSKQSNNKYAASS

SEQ ID NO: 796040 - protein, 193 aa, Homo sapiens
  misc_feature: NA.25.39.D06.K25D6-RA16.Sanger.light.1.sanger-aa
  MOD_RES (167)..(167): Any amino acid
MEAPAQLLFLLLLWLPDSSGETVLTQSPATLSLSPGERATLSCRAGQTVDNDLAWYQQKPGQAPRLLIYDTSSRATGIPARFSGSGSGTEFTLTISSLEPEDFAVYYCQLRKKWPPIFTFGPGTKVDIKRTVAAPSVFIFPPSDEQLKSGTASVVCLLNNFYPREAXVQWKVDNALQSGNSQESVTEQDSKDS

SEQ ID NO: 796041 - protein, 195 aa, Homo sapiens
  misc_feature: NA.8.19.B08.K8B8-K8B8.Sanger.light.1.sanger-aa
MEAPAQLLFLLLLWLPDTTGEIVLTQSPATLSLSPGERATLSCRASQSVTTQLAWYQHKPGQAPRPLIFDASIRATGIPARFSGSGSGTDFTLTISSLEPEDFAVYYCQHRTEWPPGATFGPGTKIEIKRTVAAPSVFIFPPSDEQLKSGTASVVCLLNNFYPREAKVQWKVDNALQSGNSQESVTEQDSKDSTY

SEQ ID NO: 796042 - protein, 194 aa, Homo sapiens
  misc_feature: NA.9.33.C11.K9C11-2-LC10.Sanger.light.1.sanger-aa
MEAPAQLLFLLLLWLPDTTGEIVLTQSPATLSLSPGERATLSCRASQSVRTSLGWYQHKSGQAPRLLIFDAFNRAPGVPGRFSGSGSGTDFTLTISSLEPEDFAVYYCQQRATFGGGATFGGGTKIEVKRTVAAPSVFIFPPSDEQLKSGTASVVCLLNNFYPREAKVQWKVDNALQSGIPRSRSPNRTARTQP

SEQ ID NO: 796043 - protein, 192 aa, Homo sapiens
  misc_feature: NA.4.59.F04.L4F4-S10.Sanger.light.1.sanger-aa
MAWIPLFLGVLAYCTGSVASYEVTQPPSVSVSPGQTAGITCSGDKLGHKFASWYQQKPGQSPILVIYQDTKRPSGIPERFSGSNSGNTATLTITGTQAVDEADYYCQAWDSSTEVFGGGTKLTVLRQPKAAPSVTLFPPSSEELQANKATLVCLISDFYPGAVTVAWKADSSPVKAGVETTTPSKQSNNKYA

SEQ ID NO: 796044 - protein, 191 aa, Homo sapiens
  misc_feature: NA.4.19.B08.L4B8-S7.Sanger.light.1.sanger-aa
MAWALLLLTLLTQGTGSWAQSALTQPPSASGSPGQSVTISCTGTSSDVGRYNYVSWYQQHPGKAPKFIIYEVTKRPSGVPDRFSASKAGNTASLTVSGLQAEDEADYYCSSYAGSYNVIFGGGTKLTVLGQPKAAPSVTLFPPSSEELQANKATLVCLISDFYPGAVTVAWKADSSPVKAGVETTTPSKQS

SEQ ID NO: 796045 - protein, 195 aa, Homo sapiens
  misc_feature: NA.17.25.C03.K17C3-S5.Sanger.light.1.sanger-aa
  MOD_RES (167)..(167): Any amino acid
MDMRVPAQLLGLLLLWLRAARCDIQMTQSPSSLSASVGVRVTITCRTSHGVKTYLNWYQQKPGKAPDLLISGASTLRSGVPSRFSGSGSGTDFNLTITTPQPEDCAIYYCQQSYSSPRTFGQGTKVEIKRTVAAPSVFIFPPSDEQLKSGTASVVCLLNNFYPREAXVQWKVDNALQSGNSQESVTEQDSKDSTY

SEQ ID NO: 796046 - protein, 194 aa, Homo sapiens
  misc_feature: NA.17.31.C09.L17C9-S13.Sanger.light.1.sanger-aa
MAWTPLFLFLLTCCPGSNSQAVVTQEPSLTVSPGGTVTLTCGSSTGAVTNGHYPYWFQQKPGQAPRTLIYDTNNKHSWTPARFSGSLVGGKAALTLSGAQPEDEAEYYCLLSYSGVRVFGGGTKLTVLGQPKAAPSVTLFPPSSEELQANKATLVCLISDFYPGAVTVAWKADSSPVKAGVETTTPSKQSNNKY

SEQ ID NO: 796047 - protein, 178 aa, Homo sapiens
  misc_feature: NA.4.39.D06.L4D6-S9.Sanger.light.1.sanger-aa
  MOD_RES (159)..(159): Any amino acid
MAWALLLLTLLTQGTGSWAQSALTQPPSASGSPGQSVTISCTGTSSDVGRYNYVSWYQQHPGKAPKFIIYEVTKRPSGVPDRFSASKAGNTASLTVSGLQAEDEADYYCSSYAGSYNVIFGGGTKLTVLGQPKAAPSVTLFPPSSEELQANKATLVCLXSDFYPGAVTVAWKADSSPV

SEQ ID NO: 796048 - protein, 191 aa, Homo sapiens
  misc_feature: NA.51.37.D04.L51D4-Flu44.Sanger.light.1.sanger-aa
MAWALLFLTLLTQGTGSWAQSALTQPASVSGSPGQSITISCTGTSGDIGVYNYVSWYQHHPGKAPKLMIYDVSDRPSGVSNRFSGSKSGNTASLTISGLQAEDEADYYCSSYTINNNWVFGGGTKLTVLGQPKAAPSVTLFPPSSEELQANKATLVCLISDFYPGAVTVAWKGRLEPSERPEWKLQPLPNS

SEQ ID NO: 796049 - protein, 194 aa, Homo sapiens
  misc_feature: NA.51.77.G11.K51G11-Flu16.Sanger.light.1.sanger-aa
  MOD_RES (167)..(167): Any amino acid
MDMRVPAQLLGLLLLWLSGGRCIIQMTQSPSSLSAYIGDRITITCRASQDISVYLNWYQQKPGKAPELLILDASTLETGVPSRFSGSGSGTHFTFTISRLQPEDVATYYCQQYHNLPLTFGGGTKVEIKRTVAAPSVFIFPPSDEQLKSGTASVVCLLNNFYPREAXVQWKVDNALQSGNSQESVTEQDSKDST

SEQ ID NO: 796050 - protein, 189 aa, Homo sapiens
  misc_feature: NA.51.26.C04.L51C4-Flu15.Sanger.light.1.sanger-aa
MAWIPLFLGVLAYCTGSLAAYDLTQPPSVSVSPGQTATITCSGDNLGSKYVSWYQHHPGRSPILLLYHDAKRPSGIPERFSGSNSGDTATLTIRGTQAVDEADYYCQAWDREAAIFGGGTSLTVLGQPKAAPSVTLFPPSSEELQANKATLVCLISDFYPGAVTVAWKADSSPVKGRSGNYNPFQTVKQ

SEQ ID NO: 796051 - protein, 177 aa, Homo sapiens
  misc_feature: NA.52.19.B08.L52B8-Flu30.Sanger.light.1.sanger-aa
  MOD_RES (173)..(173): Any amino acid
MAWALLFLTLLTQGTGSWAQSALTQPASVSGSPGQSITISCTGTGNDIGGYNYVSWYQHHPGKAPKLIIYGVGDRPSGVSNHFSGSKSGNTASLTISGLQAEDEADYYCASYTNNNNWVFGGGTKLTVLGQPKAAPSVTLFPPSSEELQANKATLVCLISDFYPGAVTVAWKXTRAQ

SEQ ID NO: 796052 - protein, 192 aa, Homo sapiens
  misc_feature: NA.51.36.D03.L51D3-Flu43.Sanger.light.1.sanger-aa
MAWATLLLPLLNLYAGSVASYELTQLPSVSVSPGQTARITCSGDVLGKNYADWYQQKPGQAPELVIYENSERYPGIPDRFSGSTSGKTTTLTINRVRTEDEADYYCLSGDEDTLVFGGGTKLTVLRQPKAAPSVTLFPPSSEELQANKATLVCLISDFYPGAVTVAWKADSSPVKAGVETTTPSKQSNNKYA

SEQ ID NO: 796053 - protein, 200 aa, Homo sapiens
  misc_feature: NA.52.14.B03.K52B3-Flu38.Sanger.light.1.sanger-aa
  MOD_RES (171)..(171): Any amino acid
MDMRVPAQLLGLLLLWLSGARCVIQMTQSPSSLSASIGDRITITCRASRDISMYLNWYQQKPGTAPKLLILDASTLETGVPSRFSGSGSGTDFTFTISRLQPEDIATYYCQQYDRLPLTFGGGTKVEIKRTVAAPSVFIFPPSDEQLKSGTASVVCLLNNFYPREAKVQWXVDNALQSGNSQESVTEQDSKDSTYSLSST

SEQ ID NO: 796054 - protein, 196 aa, Homo sapiens
  misc_feature: NA.51.30.C08.K51C8-Flu24.Sanger.light.1.sanger-aa
  MOD_RES (166)..(166): Any amino acid
MEAPAQLLFLLLLWLPDTTGEVVMTQSPATLSVSPGERATLSCRASQSVSSDLAWYQQKPGQAPRLLIYDASTRATDIPARFSGSGSGTEFTLTISSLQSEDFAIYYCQQYNNWPPYTFGQGTKLEIKRTVAAPSVFIFPPSDEQLKSGTASVVCLLNNFYPREAXVQWKVDNALQSGNSQESVTEQDSKDSTYSL

SEQ ID NO: 796055 - protein, 194 aa, Homo sapiens
  misc_feature: NA.51.52.E08.K51E8-Flu37.Sanger.light.1.sanger-aa
  MOD_RES (166)..(166): Any amino acid
MEAPAQLLFLLLLWLPDSTGEIVMTQSPATLSVSPGERVTLSCRASQSVSSDLAWYQQKPGQAPRLLIYGASSRATGIPARFSGSGSGTAFTLTINSLQSEDFAVYYCHQYNKWPPWTFGQGTKVEIKRTVAAPSVFIFPPSDEQLKSGTASVVCLLNNFYPREAXVQWKVDNALQSGNSQESVTEQDSKDSTY

SEQ ID NO: 796056 - protein, 192 aa, Homo sapiens
  misc_feature: NA.13.37.D04.L13D4-RA20.Sanger.light.1.sanger-aa
MAWALLLLSLLTQGTGSWAQSALTQPRSVSGSPGQSVTISCTGTSSDVGGYNYVSWYQQHPGKAPKIMIYDVSKRPSGVPDRFSASKSGNTASLTISGLQAEDESDYYCCSYAGSYTVLFGGGTKLTVLGQPKAAPSVTLFPPSSEELQANKATLVCLISDFYPGAVTVAWKADSSPVKGRSGNYNPFQTVK

SEQ ID NO: 796057 - protein, 194 aa, Homo sapiens
  misc_feature: NA.25.53.E09.K25E9-RA17.Sanger.light.1.sanger-aa
MEAPAQLLFLLLLWLPDSSGETVLTQSPATLSLSPGERATLSCRAGQTVDNDLAWYQQKPGQAPRLLIYDTSSRATGIPARFSGSGSGTEFTLTISSLEPEDFAVYYCQLRKKWPPIFTFGPGTKVDIKRTVAAPSVFIFPPSDEQLKSGTASVVCLLNNFYPREAKVQWKVDNALQSGNSQESVTEQDSKDST

SEQ ID NO: 796058 - protein, 179 aa, Homo sapiens
  misc_feature: NA.40.81.H04.K40H4-RA8.Sanger.light.1.sanger-aa
  MOD_RES (167)..(167): Any amino acid
MDMRVPAQLLGLLLLWLSGARCDIRMTQSPSSLSASVGDRITITCQATQDISNYLNWYQQKPGKAPNLLIYDASNLEIGVPSRFSGSGSGTYFTFTIINLQPEDIATYYCQQYDNLPLTFGGGTTVEIKRTVAAPSVFIFPPSDEQLKSGTASVVCLLNNFYPREAXVQWKGGQRPPIR

SEQ ID NO: 796059 - protein, 194 aa, Homo sapiens
  misc_feature: NA.45.42.D09.K45D9-RA19.Sanger.light.1.sanger-aa
  MOD_RES (166)..(166): Any amino acid
MEAPAQLLFLLLLWLPDSTGEIVMTQSPATLSVSPGERVTLSCRASQSVSSDLAWYQQKPGQAPRLLIYGASSRATGIPARFSGSGSGTAFTLTINSLQSEDFAVYYCHQYNKWPPWTFGQGTKVEIKRTVAAPSVFIFPPSDEQLKSGTASVVCLLNNFYPREAXVQWKVDNAPPIREFPGVGHRTGQQGLNL

SEQ ID NO: 796060 - protein, 192 aa, Homo sapiens
  misc_feature: NA.44.39.D06.L44D6-RA24.Sanger.light.1.sanger-aa
MAWALLLLTLLTQDTGSWAQSALTQPASVSGSPGQSVTISCTGASGNILSLNFVSWYQHHPGKAPKLIIYEAYKRPSGVSNRFTASKSGNTASLTISGLQAEDEADYYCCSDVRRITYVFGSGTKVTVLGQPKANPTVTLFPPSSEELQANKATLVCLISDFYPGAVTVAWKADSSPVKAGVETTTPSKQSN

SEQ ID NO: 796061 - DNA, 24 bp, Artificial Sequence
  misc_feature: Description of Artificial Sequence: Synthetic FW_short_primer1 oligonucleotide
gagagactgacagcgtatcgcctc

SEQ ID NO: 796062 - DNA, 21 bp, Artificial Sequence
  misc_feature: Description of Artificial Sequence: Synthetic kappa_GSP1 oligonucleotide
cgattggagggcgttatccac

SEQ ID NO: 796063 - DNA, 21 bp, Artificial Sequence
  misc_feature: Description of Artificial Sequence: Synthetic lambda_GSP1 oligonucleotide
tytgtgggacttccactgctc

SEQ ID NO: 796064 - DNA, 23 bp, Artificial Sequence
  misc_feature: Description of Artificial Sequence: Synthetic gamma_GSP1 oligonucleotide
tcttgtccaccttggtgttgctg

SEQ ID NO: 796065 - DNA, 18 bp, Artificial Sequence
  misc_feature: Description of Artificial Sequence: Synthetic FW_primer2 oligonucleotide
cgtatcgcctccctcgcg

SEQ ID NO: 796066 - DNA, 48 bp, Artificial Sequence
  misc_feature: Description of Artificial Sequence: Synthetic kappa_GSP_2s oligonucleotide
ctatgcgccttgccagcccgctcagtcagatggcgggaagatgaagac

SEQ ID NO: 796067 - DNA, 48 bp, Artificial Sequence
  misc_feature: Description of Artificial Sequence: Synthetic lambda_GSP_2s oligonucleotide
ctatgcgccttgccagcccgctcaggaggagggygggaacagagtgac

SEQ ID NO: 796068 - DNA, 48 bp, Artificial Sequence
  misc_feature: Description of Artificial Sequence: Synthetic gamma_GSP_2s oligonucleotide
ctatgcgccttgccagcccgctcagggaagtagtccttgaccaggcag

SEQ ID NO: 796069 - DNA, 19 bp, Artificial Sequence
  misc_feature: Description of Artificial Sequence: Synthetic RV_primer2 oligonucleotide
ctatgcgccttgccagccc

SEQ ID NO: 796070 - DNA, 11 bp, Artificial Sequence
  misc_feature: Description of Artificial Sequence: Synthetic SID.A1 oligonucleotide
acgtctcatca

SEQ ID NO: 796071 - DNA, 11 bp, Artificial Sequence
  misc_feature: Description of Artificial Sequence: Synthetic SID.A2 oligonucleotide
actcatctaca

SEQ ID NO: 796072 - DNA, 11 bp, Artificial Sequence
  misc_feature: Description of Artificial Sequence: Synthetic SID.A3 oligonucleotide
agagcgtcaca

SEQ ID NO: 796073 - DNA, 11 bp, Artificial Sequence
  misc_feature: Description of Artificial Sequence: Synthetic SID.A4 oligonucleotide
agtagtgatca

SEQ ID NO: 796074 - DNA, 11 bp, Artificial Sequence
  misc_feature: Description of Artificial Sequence: Synthetic SID.A5 oligonucleotide
atagatagaca

SEQ ID NO: 796075 - DNA, 11 bp, Artificial Sequence
  misc_feature: Description of Artificial Sequence: Synthetic SID.A6 oligonucleotide
atctactgaca

SEQ ID NO: 796076 - DNA, 11 bp, Artificial Sequence
  misc_feature: Description of Artificial Sequence: Synthetic SID.A7 oligonucleotide
cacgtgtcgca

SEQ ID NO: 796077 - DNA, 11 bp, Artificial Sequence
  misc_feature: Description of Artificial Sequence: Synthetic SID.A8 oligonucleotide
catactctaca

SEQ ID NO: 796078 - DNA, 11 bp, Artificial Sequence
  misc_feature: Description of Artificial Sequence: Synthetic SID.A9 oligonucleotide
cgagacgcgca

SEQ ID NO: 796079 - DNA, 11 bp, Artificial Sequence
  misc_feature: Description of Artificial Sequence: Synthetic SID.A10 oligonucleotide
cgtcgatctca

SEQ ID NO: 796080 - DNA, 11 bp, Artificial Sequence
  misc_feature: Description of Artificial Sequence: Synthetic SID.A11 oligonucleotide
ctacgactgca

SEQ ID NO: 796081 - DNA, 11 bp, Artificial Sequence
  misc_feature: Description of Artificial Sequence: Synthetic SID.B1 oligonucleotide
tagtgtagata

SEQ ID NO: 796082 - DNA, 11 bp, Artificial Sequence
  misc_feature: Description of Artificial Sequence: Synthetic SID.B2 oligonucleotide
tctagcgacta

SEQ ID NO: 796083 - DNA, 11 bp, Artificial Sequence
  misc_feature: Description of Artificial Sequence: Synthetic SID.B3 oligonucleotide
tgtgagtagta

SEQ ID NO: 796084 - DNA, 11 bp, Artificial Sequence
  misc_feature: Description of Artificial Sequence: Synthetic SID.B4 oligonucleotide
acagtatataa

SEQ ID NO: 796085 - DNA, 11 bp, Artificial Sequence
  misc_feature: Description of Artificial Sequence: Synthetic SID.B5 oligonucleotide
agctcacgtaa

SEQ ID NO: 796086 - DNA, 11 bp, Artificial Sequence
  misc_feature: Description of Artificial Sequence: Synthetic SID.B6 oligonucleotide
tcgatagtgaa

SEQ ID NO: 796087 - DNA, 11 bp, Artificial Sequence
  misc_feature: Description of Artificial Sequence: Synthetic SID.B7 oligonucleotide
tcgctgcgtaa

SEQ ID NO: 796088 - DNA, 11 bp, Artificial Sequence
  misc_feature: Description of Artificial Sequence: Synthetic SID.B8 oligonucleotide
tgagtcagtaa

SEQ ID NO: 796089 - DNA, 11 bp, Artificial Sequence
  misc_feature: Description of Artificial Sequence: Synthetic SID.B9 oligonucleotide
tgtagtgtgaa

SEQ ID NO: 796090 - DNA, 11 bp, Artificial Sequence
  misc_feature: Description of Artificial Sequence: Synthetic SID.B10 oligonucleotide
tgtcgtcgcaa

SEQ ID NO: 796091 - DNA, 11 bp, Artificial Sequence
  misc_feature: Description of Artificial Sequence: Synthetic SID.B11 oligonucleotide
acgacagctca

SEQ ID NO: 796092 - DNA, 18 bp, Artificial Sequence
  misc_feature: Description of Artificial Sequence: Synthetic SID.C1 oligonucleotide
tacacgtgattagggatt

SEQ ID NO: 796093 - DNA, 18 bp, Artificial Sequence
  misc_feature: Description of Artificial Sequence: Synthetic SID.C2 oligonucleotide
tacagatcgttagggaaa

SEQ ID NO: 796094 - DNA, 18 bp, Artificial Sequence
  misc_feature: Description of Artificial Sequence: Synthetic SID.C3 oligonucleotide
tagtgtagatttgggttt

SEQ ID NO: 796095 - DNA, 18 bp, Artificial Sequence
  misc_feature: Description of Artificial Sequence: Synthetic SID.C4 oligonucleotide
tctagcgactttgggttt

SEQ ID NO: 796096 - DNA, 17 bp, Artificial Sequence
  misc_feature: Description of Artificial Sequence: Synthetic SID.C5 oligonucleotide
acgcgatcgaagggttt

SEQ ID NO: 796097 - DNA, 18 bp, Artificial Sequence
  misc_feature: Description of Artificial Sequence: Synthetic SID.C6 oligonucleotide
agctcacgtattgggttt

SEQ ID NO: 796098 - DNA, 17 bp, Artificial Sequence
  misc_feature: Description of Artificial Sequence: Synthetic SID.C7 oligonucleotide
agtgctacgaagggaaa

SEQ ID NO: 796099 - DNA, 18 bp, Artificial Sequence
  misc_feature: Description of Artificial Sequence: Synthetic SID.C8 oligonucleotide
tctgacgtcaaagggaaa

SEQ ID NO: 796100 - DNA, 20 bp, Artificial Sequence
  misc_feature: Description of Artificial Sequence: Synthetic SID.C9 oligonucleotide
acgtctcatcaaggaaggaa

SEQ ID NO: 796101 - DNA, 20 bp, Artificial Sequence
  misc_feature: Description of Artificial Sequence: Synthetic SID.C10 oligonucleotide
tatagacatcaacacacaaa

SEQ ID NO: 796102 - DNA, 18 bp, Artificial Sequence
  misc_feature: Description of Artificial Sequence: Synthetic SID.C11 oligonucleotide
agtgagctcgttgggttt

SEQ ID NO: 796103 - DNA, 18 bp, Artificial Sequence
  misc_feature: Description of Artificial Sequence: Synthetic SID.D1 oligonucleotide
atcgtctgtgttgggttt

SEQ ID NO: 796104 - DNA, 18 bp, Artificial Sequence
  misc_feature: Description of Artificial Sequence: Synthetic SID.D2 oligonucleotide
cacacgatagttgggttt

SEQ ID NO: 796105 - DNA, 19 bp, Artificial Sequence
  misc_feature: Description of Artificial Sequence: Synthetic SID.D3 oligonucleotide
ctgcgtcacgatctctctt

SEQ ID NO: 796106 - DNA, 18 bp, Artificial Sequence
  misc_feature: Description of Artificial Sequence: Synthetic SID.D4 oligonucleotide
tagcatactgttgggttt

SEQ ID NO: 796107 - DNA, 18 bp, Artificial Sequence
  misc_feature: Description of Artificial Sequence: Synthetic SID.D5 oligonucleotide
tatctgatagttgggttt

SEQ ID NO: 796108 - DNA, 19 bp, Artificial Sequence
  misc_feature: Description of Artificial Sequence: Synthetic SID.D6 oligonucleotide
tgacatctcgcagttcttt

SEQ ID NO: 796109 - DNA, 20 bp, Artificial Sequence
  misc_feature: Description of Artificial Sequence: Synthetic SID.D7 oligonucleotide
tgatagagcgtaacaacaga

SEQ ID NO: 796110 - DNA, 18 bp, Artificial Sequence
  misc_feature: Description of Artificial Sequence: Synthetic SID.D8 oligonucleotide
tcacgcgagaaagggaaa

SEQ ID NO: 796111 - DNA, 17 bp, Artificial Sequence
  misc_feature: Description of Artificial Sequence: Synthetic SID.D9 oligonucleotide
acacatacgcagggaaa

SEQ ID NO: 796112 - DNA, 11 bp, Artificial Sequence
  misc_feature: Description of Artificial Sequence: Synthetic SID.D10 oligonucleotide
actagcagtaa

SEQ ID NO: 796113 - DNA, 11 bp, Artificial Sequence
  misc_feature: Description of Artificial Sequence: Synthetic SID.D11 oligonucleotide
cgcagtacgaa

SEQ ID NO: 796114 - DNA, 17 bp, Artificial Sequence
  misc_feature: Description of Artificial Sequence: Synthetic SID.E1 oligonucleotide
tgagtcagtaagggaaa

SEQ ID NO: 796115 - DNA, 17 bp, Artificial Sequence
  misc_feature: Description of Artificial Sequence: Synthetic SID.E2 oligonucleotide
actcatctacagggaaa

SEQ ID NO: 796116 - DNA, 18 bp, Artificial Sequence
  misc_feature: Description of Artificial Sequence: Synthetic SID.E3 oligonucleotide
actcgcgcacagagagaa

SEQ ID NO: 796117 - DNA, 18 bp, Artificial Sequence
  misc_feature: Description of Artificial Sequence: Synthetic SID.E4 oligonucleotide
agagcgtcacagagagaa

SEQ ID NO: 796118 - DNA, 20 bp, Artificial Sequence
  misc_feature: Description of Artificial Sequence: Synthetic SID.E5 oligonucleotide
agcgactagcaacacacaaa

SEQ ID NO: 796119 - DNA, 19 bp, Artificial Sequence
  misc_feature: Description of Artificial Sequence: Synthetic SID.E6 oligonucleotide
atctactgacaacacacaa

SEQ ID NO: 796120 - DNA, 20 bp, Artificial Sequence
  misc_feature: Description of Artificial Sequence: Synthetic SID.E7 oligonucleotide
catactctacaacacacaaa

SEQ ID NO: 796121 - DNA, 19 bp, Artificial Sequence
  misc_feature: Description of Artificial Sequence: Synthetic SID.E8 oligonucleotide
tcgagctctcagagagaaa

SEQ ID NO: 796122 - DNA, 18 bp, Artificial Sequence
  misc_feature: Description of Artificial Sequence: Synthetic SID.E9 oligonucleotide
agagagtgtgttgggttt

SEQ ID NO: 796123 - DNA, 20 bp, Artificial Sequence
  misc_feature: Description of Artificial Sequence: Synthetic SID.E10 oligonucleotide
atcgtagcagaacacacaaa

SEQ ID NO: 796124 - DNA, 18 bp, Artificial Sequence
  misc_feature: Description of Artificial Sequence: Synthetic SID.E11 oligonucleotide
cactcgcacgttgggttt

SEQ ID NO: 796125 - DNA, 20 bp, Artificial Sequence
  misc_feature: Description of Artificial Sequence: Synthetic SID.F1 oligonucleotide
cagacgtctgaacacacaaa

SEQ ID NO: 796126 - DNA, 18 bp, Artificial Sequence
  misc_feature: Description of Artificial Sequence: Synthetic SID.F2 oligonucleotide
ctcgatatagttgggttt

SEQ ID NO: 796127 - DNA, 18 bp, Artificial Sequence
  misc_feature: Description of Artificial Sequence: Synthetic SID.F3 oligonucleotide
tctgatcgagaagggaaa

SEQ ID NO: 796128 - DNA, 18 bp, Artificial Sequence
  misc_feature: Description of Artificial Sequence: Synthetic SID.F4 oligonucleotide
tacacacacttagggatt

SEQ ID NO: 796129 - DNA, 16 bp, Artificial Sequence
  misc_feature: Description of Artificial Sequence: Synthetic SID.F5 oligonucleotide
tacgtcatcagggaaa

SEQ ID NO: 796130 - DNA, 17 bp, Artificial Sequence
  misc_feature: Description of Artificial Sequence: Synthetic SID.F6 oligonucleotide
ctacgctctaagggaaa

SEQ ID NO: 796131 - DNA, 18 bp, Artificial Sequence
  misc_feature: Description of Artificial Sequence: Synthetic SID.F7 oligonucleotide
tagtcgcataaagggaaa

SEQ ID NO: 796132 - DNA, 11 bp, Artificial Sequence
  misc_feature: Description of Artificial Sequence: Synthetic SID.F8 oligonucleotide
cgatcgtataa

SEQ ID NO: 796133 - DNA, 11 bp, Artificial Sequence
  misc_feature: Description of Artificial Sequence: Synthetic SID.F9 oligonucleotide
cgcgtatacaa

SEQ ID NO: 796134 - DNA, 11 bp, Artificial Sequence
  misc_feature: Description of Artificial Sequence: Synthetic SID.F10 oligonucleotide
ctacgctctaa

SEQ ID NO: 796135 - DNA, 11 bp, Artificial Sequence
  misc_feature: Description of Artificial Sequence: Synthetic SID.F11 oligonucleotide
tcacgcgagaa

SEQ ID NO: 796136 - DNA, 18 bp, Artificial Sequence
  misc_feature: Description of Artificial Sequence: Synthetic SID.G1 oligonucleotide
agtatacatattgggttt

SEQ ID NO: 796137 - DNA, 17 bp, Artificial Sequence
  misc_feature: Description of Artificial Sequence: Synthetic SID.G2 oligonucleotide
tcgatagtgaagggaaa

SEQ ID NO: 796138 - DNA, 19 bp, Artificial Sequence
  misc_feature: Description of Artificial Sequence: Synthetic SID.G3 oligonucleotide
tcgctgcgtaaaggagaaa

SEQ ID NO: 796139 - DNA, 17 bp, Artificial Sequence
  misc_feature: Description of Artificial Sequence: Synthetic SID.G4 oligonucleotide
tgtagtgtgaagggaaa

SEQ ID NO: 796140 - DNA, 18 bp, Artificial Sequence
  misc_feature: Description of Artificial Sequence: Synthetic SID.G5 oligonucleotide
tgtcgtcgcaagagagag

SEQ ID NO: 796141 - DNA, 18 bp, Artificial Sequence
  misc_feature: Description of Artificial Sequence: Synthetic SID.G6 oligonucleotide
ctacgactgcaagggaaa

SEQ ID NO: 796142 - DNA, 11 bp, Artificial Sequence
  misc_feature: Description of Artificial Sequence: Synthetic SID.G7 oligonucleotide
ctctacgctca

SEQ ID NO: 796143 - DNA, 11 bp, Artificial Sequence
  misc_feature: Description of Artificial Sequence: Synthetic SID.G8 oligonucleotide
tagctctatca

SEQ ID NO: 796144 - DNA, 11 bp, Artificial Sequence
  misc_feature: Description of Artificial Sequence: Synthetic SID.G9 oligonucleotide
tatagacatca

SEQ ID NO: 796145 - DNA, 11 bp, Artificial Sequence
  misc_feature: Description of Artificial Sequence: Synthetic SID.G10 oligonucleotide
tcactcataca

SEQ ID NO: 796146 - DNA, 18 bp, Artificial Sequence
  misc_feature: Description of Artificial Sequence: Synthetic SID.G11 oligonucleotide
ctagtcactcaagggaaa

SEQ ID NO: 796147 - DNA, 18 bp, Artificial Sequence
  misc_feature: Description of Artificial Sequence: Synthetic SID.H1 oligonucleotide
tgtgagtagtttgggttt

SEQ ID NO: 796148 - DNA, 17 bp, Artificial Sequence
  misc_feature: Description of Artificial Sequence: Synthetic SID.H2 oligonucleotide
tgtcacacgaagggaaa

SEQ ID NO: 796149 - DNA, 18 bp, Artificial Sequence
  misc_feature: Description of Artificial Sequence: Synthetic SID.H3 oligonucleotide
ctgtgcgtcgaagggaaa

SEQ ID NO: 796150 - DNA, 14 bp, Artificial Sequence
  misc_feature: Description of Artificial Sequence: Synthetic SID.H4 oligonucleotide
tagtgtagattcgc

SEQ ID NO: 796151 - DNA, 14 bp, Artificial Sequence
  misc_feature: Description of Artificial Sequence: Synthetic SID.H5 oligonucleotide
tcgagctctctcgc

SEQ ID NO: 796152 - DNA, 14 bp, Artificial Sequence
  misc_feature: Description of Artificial Sequence: Synthetic SID.H6 oligonucleotide
atcacgtgcgtcgc

SEQ ID NO: 796153 - DNA, 14 bp, Artificial Sequence
  misc_feature: Description of Artificial Sequence: Synthetic SID.H7 oligonucleotide
cagacgtctgtcgc

SEQ ID NO: 796154 - DNA, 14 bp, Artificial Sequence
  misc_feature: Description of Artificial Sequence: Synthetic SID.H8 oligonucleotide
tatcactcagtcgc

SEQ ID NO: 796155 - DNA, 18 bp, Artificial Sequence
  misc_feature: Description of Artificial Sequence: Synthetic SID.H9 oligonucleotide
tgctatagacttgggttt

SEQ ID NO: 796156 - DNA, 18 bp, Artificial Sequence
  misc_feature: Description of Artificial Sequence: Synthetic SID.H10 oligonucleotide
cagtactgcgttgggttt

SEQ ID NO: 796157 - DNA, 20 bp, Artificial Sequence
  misc_feature: Description of Artificial Sequence: Synthetic SID.H11 oligonucleotide
cgacagcgagaacacacaaa

SEQ ID NO: 796158 - DNA, 11 bp, Artificial Sequence
  misc_feature: Description of Artificial Sequence: Synthetic SID.Column_12 oligonucleotide
tatgctagtaa

SEQ ID NO: 796159 - DNA, 10 bp, Artificial Sequence
  misc_feature: Description of Artificial Sequence: Synthetic PID.1 oligonucleotide
acgagtgcgt

SEQ ID NO: 796160 - DNA, 10 bp, Artificial Sequence
  misc_feature: Description of Artificial Sequence: Synthetic PID.2 oligonucleotide
acgctcgaca

SEQ ID NO: 796161 - DNA, 10 bp, Artificial Sequence
  misc_feature: Description of Artificial Sequence: Synthetic PID.3 oligonucleotide
agacgcactc

SEQ ID NO: 796162 - DNA, 10 bp, Artificial Sequence
  misc_feature: Description of Artificial Sequence: Synthetic PID.4 oligonucleotide
agcactgtag

SEQ ID NO: 796163 - DNA, 10 bp, Artificial Sequence
  misc_feature: Description of Artificial Sequence: Synthetic PID.5 oligonucleotide
atcagacacg

SEQ ID NO: 796164 - DNA, 10 bp, Artificial Sequence
  misc_feature: Description of Artificial Sequence: Synthetic PID.6 oligonucleotide
atatcgcgag

SEQ ID NO: 796165 - DNA, 10 bp, Artificial Sequence
  misc_feature: Description of Artificial Sequence: Synthetic PID.7 oligonucleotide
cgtgtctcta

SEQ ID NO: 796166 - DNA, 10 bp, Artificial Sequence
  misc_feature: Description of Artificial Sequence: Synthetic PID.8 oligonucleotide
ctcgcgtgtc

SEQ ID NO: 796167 - DNA, 10 bp, Artificial Sequence
  misc_feature: Description of Artificial Sequence: Synthetic PID.9 oligonucleotide
tgatacgtct

SEQ ID NO: 796168 - DNA, 10 bp, Artificial Sequence
  misc_feature: Description of Artificial Sequence: Synthetic PID.10 oligonucleotide
catagtagtg

SEQ ID NO: 796169 - DNA, 10 bp, Artificial Sequence
  misc_feature: Description of Artificial Sequence: Synthetic PID.11 oligonucleotide
cgagagatac

SEQ ID NO: 796170 - DNA, 10 bp, Artificial Sequence
  misc_feature: Description of Artificial Sequence: Synthetic PID.12 oligonucleotide
atacgacgta

SEQ ID NO: 796171 - DNA, 10 bp, Artificial Sequence
  misc_feature: Description of Artificial Sequence: Synthetic PID.13 oligonucleotide
tcacgtacta

SEQ ID NO: 796172 - DNA, 10 bp, Artificial Sequence
  misc_feature: Description of Artificial Sequence: Synthetic PID.14 oligonucleotide
cgtctagtac

SEQ ID NO: 796173 - DNA, 10 bp, Artificial Sequence
  misc_feature: Description of Artificial Sequence: Synthetic PID.15 oligonucleotide
tctacgtagc

SEQ ID NO: 796174 - DNA, 10 bp, Artificial Sequence
  misc_feature: Description of Artificial Sequence: Synthetic PID.16 oligonucleotide
tgtactactc

SEQ ID NO: 796175 - DNA, 10 bp, Artificial Sequence
  misc_feature: Description of Artificial Sequence: Synthetic PID.17 oligonucleotide
cgtagactag

SEQ ID NO: 796176 - DNA, 10 bp, Artificial Sequence
  misc_feature: Description of Artificial Sequence: Synthetic PID.18 oligonucleotide
tacgagtatg

SEQ ID NO: 796177 - DNA, 10 bp, Artificial Sequence
  misc_feature: Description of Artificial Sequence: Synthetic PID.19 oligonucleotide
tactctcgtg

SEQ ID NO: 796178 - DNA, 10 bp, Artificial Sequence
  misc_feature: Description of Artificial Sequence: Synthetic PID.20 oligonucleotide
tagagacgag

SEQ ID NO: 796179 - DNA, 10 bp, Artificial Sequence
  misc_feature: Description of Artificial Sequence: Synthetic PID.21 oligonucleotide
tcgtcgctcg

SEQ ID NO: 796180 - DNA, 10 bp, Artificial Sequence
  misc_feature: Description of Artificial Sequence: Synthetic PID.22 oligonucleotide
acatacgcgt

SEQ ID NO: 796181 - DNA, 10 bp, Artificial Sequence
  misc_feature: Description of Artificial Sequence: Synthetic PID.23 oligonucleotide
acgcgagtat

SEQ ID NO: 796182 - DNA, 10 bp, Artificial Sequence
  misc_feature: Description of Artificial Sequence: Synthetic PID.24 oligonucleotide
actactatgt

SEQ ID NO: 796183 - DNA, 10 bp, Artificial Sequence
  misc_feature: Description of Artificial Sequence: Synthetic PID.25 oligonucleotide
actgtacagt

SEQ ID NO: 796184 - DNA, 10 bp, Artificial Sequence
  misc_feature: Description of Artificial Sequence: Synthetic PID.26 oligonucleotide
agactatact

SEQ ID NO: 796185 - DNA, 10 bp, Artificial Sequence
  misc_feature: Description of Artificial Sequence: Synthetic PID.27 oligonucleotide
agcgtcgtct

SEQ ID NO: 796186 - DNA, 10 bp, Artificial Sequence
  misc_feature: Description of Artificial Sequence: Synthetic PID.28 oligonucleotide
agtacgctat

SEQ ID NO: 796187 - DNA, 10 bp, Artificial Sequence
  misc_feature: Description of Artificial Sequence: Synthetic PID.29 oligonucleotide
atagagtact

SEQ ID NO: 796188 - DNA, 10 bp, Artificial Sequence
  misc_feature: Description of Artificial Sequence: Synthetic PID.30 oligonucleotide
cacgctacgt

SEQ ID NO: 796189 - DNA, 10 bp, Artificial Sequence
  misc_feature: Description of Artificial Sequence: Synthetic PID.31 oligonucleotide
cagtagacgt

SEQ ID NO: 796190 - DNA, 10 bp, Artificial Sequence
  misc_feature: Description of Artificial Sequence: Synthetic PID.32 oligonucleotide
cgacgtgact

SEQ ID NO: 796191 - DNA, 10 bp, Artificial Sequence
  misc_feature: Description of Artificial Sequence: Synthetic PID.33 oligonucleotide
tacacacact

SEQ ID NO: 796192 - DNA, 10 bp, Artificial Sequence
  misc_feature: Description of Artificial Sequence: Synthetic PID.34 oligonucleotide
tacacgtgat

SEQ ID NO: 796193 - DNA, 10 bp, Artificial Sequence
  misc_feature: Description of Artificial Sequence: Synthetic PID.35 oligonucleotide
tacagatcgt

SEQ ID NO: 796194 - DNA, 10 bp, Artificial Sequence
  misc_feature: Description of Artificial Sequence: Synthetic PID.36 oligonucleotide
tacgctgtct

SEQ ID NO: 796195 - DNA, 10 bp, Artificial Sequence
  misc_feature: Description of Artificial Sequence: Synthetic PID.37 oligonucleotide
tagtgtagat

SEQ ID NO: 796196 - DNA, 10 bp, Artificial Sequence
  misc_feature: Description of Artificial Sequence: Synthetic PID.38 oligonucleotide
tcgatcacgt

SEQ ID NO: 796197 - DNA, 10 bp, Artificial Sequence
  misc_feature: Description of Artificial Sequence: Synthetic PID.39 oligonucleotide
tcgcactagt

SEQ ID NO: 796198 - DNA, 10 bp, Artificial Sequence
  misc_feature: Description of Artificial Sequence: Synthetic PID.40 oligonucleotide
tctagcgact

SEQ ID NO: 796199 - DNA, 10 bp, Artificial Sequence
  misc_feature: Description of Artificial Sequence: Synthetic PID.41 oligonucleotide
tctatactat

SEQ ID NO: 796200 - DNA, 10 bp, Artificial Sequence
  misc_feature: Description of Artificial Sequence: Synthetic PID.42 oligonucleotide
tgacgtatgt

SEQ ID NO: 796201 - DNA, 10 bp, Artificial Sequence
  misc_feature: Description of Artificial Sequence: Synthetic PID.43 oligonucleotide
tgtgagtagt

SEQ ID NO: 796202 - DNA, 10 bp, Artificial Sequence
  misc_feature: Description of Artificial Sequence: Synthetic PID.44 oligonucleotide
acagtatata

SEQ ID NO: 796203 - DNA, 10 bp, Artificial Sequence
  misc_feature: Description of Artificial Sequence: Synthetic PID.45 oligonucleotide
acgcgatcga

SEQ ID NO: 796204 - DNA, 10 bp, Artificial Sequence
  misc_feature: Description of Artificial Sequence: Synthetic PID.46 oligonucleotide
actagcagta

SEQ ID NO: 796205 - DNA, 10 bp, Artificial Sequence
  misc_feature: Description of Artificial Sequence: Synthetic PID.47 oligonucleotide
agctcacgta

SEQ ID NO: 796206 - DNA, 10 bp, Artificial Sequence
  misc_feature: Description of Artificial Sequence: Synthetic PID.48 oligonucleotide
agtatacata

SEQ ID NO: 796207 - DNA, 10 bp, Artificial Sequence
  misc_feature: Description of Artificial Sequence: Synthetic PID.49 oligonucleotide
agtcgagaga

SEQ ID NO: 796208 - DNA, 10 bp, Artificial Sequence
  misc_feature: Description of Artificial Sequence: Synthetic PID.50 oligonucleotide
agtgctacga

SEQ ID NO: 796209 - DNA, 10 bp, Artificial Sequence
  misc_feature: Description of Artificial Sequence: Synthetic PID.51 oligonucleotide
cgatcgtata

SEQ ID NO: 796210 - DNA, 10 bp, Artificial Sequence
  misc_feature: Description of Artificial Sequence: Synthetic PID.52 oligonucleotide
cgcagtacga

SEQ ID NO: 796211 - DNA, 10 bp, Artificial Sequence
  misc_feature: Description of Artificial Sequence: Synthetic PID.53 oligonucleotide
cgcgtataca

SEQ ID NO: 796212 - DNA, 10 bp, Artificial Sequence
  misc_feature: Description of Artificial Sequence: Synthetic PID.54 oligonucleotide
cgtacagtca

SEQ ID NO: 796213 - DNA, 10 bp, Artificial Sequence
  misc_feature: Description of Artificial Sequence: Synthetic PID.55 oligonucleotide
cgtactcaga

SEQ ID NO: 796214 - DNA, 10 bp, Artificial Sequence
  misc_feature: Description of Artificial Sequence: Synthetic PID.56 oligonucleotide
ctacgctcta

SEQ ID NO: 796215 - DNA, 10 bp, Artificial Sequence
  misc_feature: Description of Artificial Sequence: Synthetic PID.57 oligonucleotide
ctatagcgta

SEQ ID NO: 796216 - DNA, 10 bp, Artificial Sequence
  misc_feature: Description of Artificial Sequence: Synthetic PID.58 oligonucleotide
tacgtcatca

SEQ ID NO: 796217 - DNA, 10 bp, Artificial Sequence
  misc_feature: Description of Artificial Sequence: Synthetic PID.59 oligonucleotide
tagtcgcata

SEQ ID NO: 796218 - DNA, 10 bp, Artificial Sequence
  misc_feature: Description of Artificial Sequence: Synthetic PID.60 oligonucleotide
tatatataca

SEQ ID NO: 796219 - DNA, 26 bp, Artificial Sequence
  misc_feature: Description of Artificial Sequence: Synthetic CP.A1 oligonucleotide
ggtgctcgatttagacgtctcatcag

SEQ ID NO: 796220 - DNA, 27 bp, Artificial Sequence
  misc_feature: Description of Artificial Sequence: Synthetic CP.A2 oligonucleotide
cggtgctcgatttagactcatctacag

SEQ ID NO: 796221 - DNA, 25 bp, Artificial Sequence
  misc_feature: Description of Artificial Sequence: Synthetic CP.A3 oligonucleotide
gtgctcgatttagagagcgtcacag

SEQ ID NO: 796222 - DNA, 26 bp, Artificial Sequence
  misc_feature: Description of Artificial Sequence: Synthetic CP.A4 oligonucleotide
cggtgctcgatttagagtagtgatca

SEQ ID NO: 796223 - DNA, 28 bp, Artificial Sequence
  misc_feature: Description of Artificial Sequence: Synthetic CP.A5 oligonucleotide
accggtgctcgatttagatagatagaca

SEQ ID NO: 796224 - DNA, 27 bp, Artificial Sequence
  misc_feature: Description of Artificial Sequence: Synthetic CP.A6 oligonucleotide
cggtgctcgatttagatctactgacag

SEQ ID NO: 796225 - DNA, 21 bp, Artificial Sequence
  misc_feature: Description of Artificial Sequence: Synthetic CP.A7 oligonucleotide
ctcgatttagcacgtgtcgca

SEQ ID NO: 796226 - DNA, 26 bp, Artificial Sequence
  misc_feature: Description of Artificial Sequence: Synthetic CP.A8 oligonucleotide
cggtgctcgatttagcatactctaca

SEQ ID NO: 796227 - DNA, 19 bp, Artificial Sequence
  misc_feature: Description of Artificial Sequence: Synthetic CP.A9 oligonucleotide
cgatttagcgagacgcgca

SEQ ID NO: 796228 - DNA, 23 bp, Artificial Sequence
  misc_feature: Description of Artificial Sequence: Synthetic CP.A10 oligonucleotide
tgctcgatttagcgtcgatctca

SEQ ID NO: 796229 - DNA, 24 bp, Artificial Sequence
  misc_feature: Description of Artificial Sequence: Synthetic CP.A11 oligonucleotide
gtgctcgatttagctacgactgca

SEQ ID NO: 796230 - DNA, 30 bp, Artificial Sequence
  misc_feature: Description of Artificial Sequence: Synthetic CP.B1 oligonucleotide
gaccggtgctcgatttagtagtgtagatag

SEQ ID NO: 796231 - DNA, 27 bp, Artificial Sequence
  misc_feature: Description of Artificial Sequence: Synthetic CP.B2 oligonucleotide
cggtgctcgatttagtctagcgactag

SEQ ID NO: 796232 - DNA, 29 bp, Artificial Sequence
  misc_feature: Description of Artificial Sequence: Synthetic CP.B3 oligonucleotide
accggtgctcgatttagtgtgagtagtag

SEQ ID NO: 796233 - DNA, 30 bp, Artificial Sequence
  misc_feature: Description of Artificial Sequence: Synthetic CP.B4 oligonucleotide
cgaccggtgctcgatttagacagtatataa

SEQ ID NO: 796234 - DNA, 26 bp, Artificial Sequence
  misc_feature: Description of Artificial Sequence: Synthetic CP.B5 oligonucleotide
ggtgctcgatttagagctcacgtaag

SEQ ID NO: 796235 - DNA, 26 bp, Artificial Sequence
  misc_feature: Description of Artificial Sequence: Synthetic CP.B6 oligonucleotide
cggtgctcgatttagtcgatagtgaa

SEQ ID NO: 796236 - DNA, 24 bp, Artificial Sequence
  misc_feature: Description of Artificial Sequence: Synthetic CP.B7 oligonucleotide
tgctcgatttagtcgctgcgtaag

SEQ ID NO: 796237 - DNA, 26 bp, Artificial Sequence
  misc_feature: Description of Artificial Sequence: Synthetic CP.B8 oligonucleotide
cggtgctcgatttagtgagtcagtaa

SEQ ID NO: 796238 - DNA, 26 bp, Artificial Sequence
  misc_feature: Description of Artificial Sequence: Synthetic CP.B9 oligonucleotide
cggtgctcgatttagtgtagtgtgaa

SEQ ID NO: 796239 - DNA, 22 bp, Artificial Sequence
  misc_feature: Description of Artificial Sequence: Synthetic CP.B10 oligonucleotide
gctcgatttagtgtcgtcgcaa

SEQ ID NO: 796240 - DNA, 24 bp, Artificial Sequence
  misc_feature: Description of Artificial Sequence: Synthetic CP.B11 oligonucleotide
gtgctcgatttagacgacagctca

SEQ ID NO: 796241 - DNA, 26 bp, Artificial Sequence
  misc_feature: Description of Artificial Sequence: Synthetic CP.C1 oligonucleotide
cggtgctcgatttagtacacgtgatt

SEQ ID NO: 796242 - DNA, 26 bp, Artificial Sequence
  misc_feature: Description of Artificial Sequence: Synthetic CP.C2 oligonucleotide
cggtgctcgatttagtacagatcgtt

SEQ ID NO: 796243 - DNA, 30 bp, Artificial Sequence
  misc_feature: Description of Artificial Sequence: Synthetic CP.C3 oligonucleotide
gaccggtgctcgatttagtagtgtagattt

SEQ ID NO: 796244 - DNA, 27 bp, Artificial Sequence
  misc_feature: Description of Artificial Sequence: Synthetic CP.C4 oligonucleotide
cggtgctcgatttagtctagcgacttt

SEQ ID NO: 796245 - DNA, 22 bp, Artificial Sequence
  misc_feature: Description of Artificial Sequence: Synthetic CP.C5 oligonucleotide
gctcgatttagacgcgatcgaa

SEQ ID NO: 796246 - DNA, 26 bp, Artificial Sequence
  misc_feature: Description of Artificial Sequence: Synthetic CP.C6 oligonucleotide
ggtgctcgatttagagctcacgtatt

SEQ ID NO: 796247 - DNA, 25 bp, Artificial Sequence
  misc_feature: Description of Artificial Sequence: Synthetic CP.C7 oligonucleotide
ggtgctcgatttagagtgctacgaa

SEQ ID NO: 796248 - DNA, 25 bp, Artificial Sequence
  misc_feature: Description of Artificial Sequence: Synthetic CP.C8 oligonucleotide
ggtgctcgatttagtctgacgtcaa

SEQ ID NO: 796249 - DNA, 26 bp, Artificial Sequence
  misc_feature: Description of Artificial Sequence: Synthetic CP.C9 oligonucleotide
ggtgctcgatttagacgtctcatcaa

SEQ ID NO: 796250 - DNA, 29 bp, Artificial Sequence
  misc_feature: Description of Artificial Sequence: Synthetic CP.C10 oligonucleotide
accggtgctcgatttagtatagacatcaa

SEQ ID NO: 796251 - DNA, 25 bp, Artificial Sequence
  misc_feature: Description of Artificial Sequence: Synthetic CP.C11 oligonucleotide
ggtgctcgatttagagtgagctcgt

SEQ ID NO: 796252 - DNA, 25 bp, Artificial Sequence
  misc_feature: Description of Artificial Sequence: Synthetic CP.D1 oligonucleotide
ggtgctcgatttagatcgtctgtgt

SEQ ID NO: 796253 - DNA, 25 bp, Artificial Sequence
  misc_feature: Description of Artificial Sequence: Synthetic CP.D2 oligonucleotide
ggtgctcgatttagcacacgatagt

SEQ ID NO: 796254 - DNA, 22 bp, Artificial Sequence
  misc_feature: Description of Artificial Sequence: Synthetic CP.D3 oligonucleotide
gctcgatttagctgcgtcacga

SEQ ID NO: 796255 - DNA, 27 bp, Artificial Sequence
  misc_feature: Description of Artificial Sequence: Synthetic CP.D4 oligonucleotide
ccggtgctcgatttagtagcatactgt

SEQ ID NO: 796256 - DNA, 29 bp, Artificial Sequence
  misc_feature: Description of Artificial Sequence: Synthetic CP.D5 oligonucleotide
gaccggtgctcgatttagtatctgatagt

SEQ ID NO: 796257 - DNA, 24 bp, Artificial Sequence
  misc_feature: Description of Artificial Sequence: Synthetic CP.D6 oligonucleotide
gtgctcgatttagtgacatctcgc

SEQ ID NO: 796258 - DNA, 26 bp, Artificial Sequence
  misc_feature: Description of Artificial Sequence: Synthetic CP.D7 oligonucleotide
cggtgctcgatttagtgatagagcgt

SEQ ID NO: 796259 - DNA, 23 bp, Artificial Sequence
  misc_feature: Description of Artificial Sequence: Synthetic CP.D8 oligonucleotide
gctcgatttagtcacgcgagaaa

SEQ ID NO: 796260 - DNA, 25 bp, Artificial Sequence
  misc_feature: Description of Artificial Sequence: Synthetic CP.D9 oligonucleotide
ggtgctcgatttagacacatacgca

SEQ ID NO: 796261 - DNA, 27 bp, Artificial Sequence
  misc_feature: Description of Artificial Sequence: Synthetic CP.D10 oligonucleotide
ccggtgctcgatttagactagcagtaa

SEQ ID NO: 796262 - DNA, 23 bp, Artificial Sequence
  misc_feature: Description of Artificial Sequence: Synthetic CP.D11 oligonucleotide
tgctcgatttagcgcagtacgaa

SEQ ID NO: 796263 - DNA, 26 bp, Artificial Sequence
  misc_feature: Description of Artificial Sequence: Synthetic CP.E1 oligonucleotide
cggtgctcgatttagtgagtcagtaa

SEQ ID NO: 796264 - DNA, 27 bp, Artificial Sequence
  misc_feature: Description of Artificial Sequence: Synthetic CP.E2 oligonucleotide
cggtgctcgatttagactcatctacag

SEQ ID NO: 796265 - DNA, 22 bp, Artificial Sequence
  misc_feature: Description of Artificial Sequence: Synthetic CP.E3 oligonucleotide
gctcgatttagactcgcgcaca

SEQ ID NO: 796266 - DNA, 25 bp, Artificial Sequence
  misc_feature: Description of Artificial Sequence: Synthetic CP.E4 oligonucleotide
gtgctcgatttagagagcgtcacag

SEQ ID NO: 796267 - DNA, 25 bp, Artificial Sequence
  misc_feature: Description of Artificial Sequence: Synthetic CP.E5 oligonucleotide
ggtgctcgatttagagcgactagca

SEQ ID NO: 796268 - DNA, 27 bp, Artificial Sequence
  misc_feature: Description of Artificial Sequence: Synthetic CP.E6 oligonucleotide
cggtgctcgatttagatctactgacaa

SEQ ID NO: 796269 - DNA, 26 bp, Artificial Sequence
  misc_feature: Description of Artificial Sequence: Synthetic CP.E7 oligonucleotide
cggtgctcgatttagcatactctaca

SEQ ID NO: 796270 - DNA, 25 bp, Artificial Sequence
  misc_feature: Description of Artificial Sequence: Synthetic CP.E8 oligonucleotide
gtgctcgatttagtcgagctctcag

SEQ ID NO: 796271 - DNA, 26 bp, Artificial Sequence
  misc_feature: Description of Artificial Sequence: Synthetic CP.E9 oligonucleotide
cggtgctcgatttagagagagtgtgt

SEQ ID NO: 796272 - DNA, 25 bp, Artificial Sequence
  misc_feature: Description of Artificial Sequence: Synthetic CP.E10 oligonucleotide
ggtgctcgatttagatcgtagcaga

SEQ ID NO: 796273 - DNA, 22 bp, Artificial Sequence
  misc_feature: Description of Artificial Sequence: Synthetic CP.E11 oligonucleotide
gctcgatttagcactcgcacgt

SEQ ID NO: 796274 - DNA, 24 bp, Artificial Sequence
  misc_feature: Description of Artificial Sequence: Synthetic CP.F1 oligonucleotide
tgctcgatttagcagacgtctgaa

SEQ ID NO: 796275 - DNA, 26 bp, Artificial Sequence
  misc_feature: Description of Artificial Sequence: Synthetic CP.F2 oligonucleotide
cggtgctcgatttagctcgatatagt

SEQ ID NO: 796276 - DNA, 25 bp, Artificial Sequence
  misc_feature: Description of Artificial Sequence: Synthetic CP.F3 oligonucleotide
ggtgctcgatttagtctgatcgaga

SEQ ID NO: 796277 - DNA, 26 bp, Artificial Sequence
  misc_feature: Description of Artificial Sequence: Synthetic CP.F4 oligonucleotide
cggtgctcgatttagtacacacactt

SEQ ID NO: 796278 - DNA, 25 bp, Artificial Sequence
  misc_feature: Description of Artificial Sequence: Synthetic CP.F5 oligonucleotide
cggtgctcgatttagtacgtcatca

SEQ ID NO: 796279 - DNA, 26 bp, Artificial Sequence
  misc_feature: Description of Artificial Sequence: Synthetic CP.F6 oligonucleotide
cggtgctcgatttagctacgctctaa

SEQ ID NO: 796280 - DNA, 26 bp, Artificial Sequence
  misc_feature: Description of Artificial Sequence: Synthetic CP.F7 oligonucleotide
cggtgctcgatttagtagtcgcataa

SEQ ID NO: 796281 - DNA, 25 bp, Artificial Sequence
  misc_feature: Description of Artificial Sequence: Synthetic CP.F8 oligonucleotide
ggtgctcgatttagcgatcgtataa

SEQ ID NO: 796282 - DNA, 25 bp, Artificial Sequence
  misc_feature: Description of Artificial Sequence: Synthetic CP.F9 oligonucleotide
ggtgctcgatttagcgcgtatacaa

SEQ ID NO: 796283 - DNA, 26 bp, Artificial Sequence
  misc_feature: Description of Artificial Sequence: Synthetic CP.F10 oligonucleotide
cggtgctcgatttagctacgctctaa

SEQ ID NO: 796284 - DNA, 23 bp, Artificial Sequence
  misc_feature: Description of Artificial Sequence: Synthetic CP.F11 oligonucleotide
gctcgatttagtcacgcgagaag

SEQ ID NO: 796285 - DNA, 31 bp, Artificial Sequence
  misc_feature: Description of Artificial Sequence: Synthetic CP.G1 oligonucleotide
acgaccggtgctcgatttagagtatacatat

SEQ ID NO: 796286 - DNA, 26 bp, Artificial Sequence
  misc_feature: Description of Artificial Sequence: Synthetic CP.G2 oligonucleotide
cggtgctcgatttagtcgatagtgaa

SEQ ID NO: 796287 - DNA, 23 bp, Artificial Sequence
  misc_feature: Description of Artificial Sequence: Synthetic CP.G3 oligonucleotide
gctcgatttagtcgctgcgtaaa

SEQ ID NO: 796288 - DNA, 26 bp, Artificial Sequence
  misc_feature: Description of Artificial Sequence: Synthetic CP.G4 oligonucleotide
cggtgctcgatttagtgtagtgtgaa

SEQ ID NO: 796289 - DNA, 22 bp, Artificial Sequence
  misc_feature: Description of Artificial Sequence: Synthetic CP.G5 oligonucleotide
gctcgatttagtgtcgtcgcaa

SEQ ID NO: 796290 - DNA, 24 bp, Artificial Sequence
  misc_feature: Description of Artificial Sequence: Synthetic CP.G6 oligonucleotide
gtgctcgatttagctacgactgca

SEQ ID NO: 796291 - DNA, 25 bp, Artificial Sequence
  misc_feature: Description of Artificial Sequence: Synthetic CP.G7 oligonucleotide
ggtgctcgatttagctctacgctca

SEQ ID NO: 796292 - DNA, 27 bp, Artificial Sequence
  misc_feature: Description of Artificial Sequence: Synthetic CP.G8 oligonucleotide
ccggtgctcgatttagtagctctatca

SEQ ID NO: 796293 - DNA, 29 bp, Artificial Sequence
  misc_feature: Description of Artificial Sequence: Synthetic CP.G9 oligonucleotide
accggtgctcgatttagtatagacatcag

SEQ ID NO: 796294 - DNA, 26 bp, Artificial Sequence
  misc_feature: Description of Artificial Sequence: Synthetic CP.G10 oligonucleotide
cggtgctcgatttagtcactcataca

SEQ ID NO: 796295 - DNA, 26 bp, Artificial Sequence
  misc_feature: Description of Artificial Sequence: Synthetic CP.G11 oligonucleotide
cggtgctcgatttagctagtcactca

SEQ ID NO: 796296 - DNA, 27 bp, Artificial Sequence
  misc_feature: Description of Artificial Sequence: Synthetic CP.H1 oligonucleotide
cggtgctcgatttagtgtgagtagttt

SEQ ID NO: 796297 - DNA, 25 bp, Artificial Sequence
  misc_feature: Description of Artificial Sequence: Synthetic CP.H2 oligonucleotide
ggtgctcgatttagtgtcacacgaa

SEQ ID NO: 796298 - DNA, 22 bp, Artificial Sequence
  misc_feature: Description of Artificial Sequence: Synthetic CP.H3 oligonucleotide
gctcgatttagctgtgcgtcga

SEQ ID NO: 796299 - DNA, 30 bp, Artificial Sequence
  misc_feature: Description of Artificial Sequence: Synthetic CP.H4 oligonucleotide
gaccggtgctcgatttagtagtgtagattc

SEQ ID NO: 796300 - DNA, 26 bp, Artificial Sequence
  misc_feature: Description of Artificial Sequence: Synthetic CP.H5 oligonucleotide
ggtgctcgatttagtcgagctctctc

SEQ ID NO: 796301 - DNA, 23 bp, Artificial Sequence
  misc_feature: Description of Artificial Sequence: Synthetic CP.H6 oligonucleotide
tgctcgatttagatcacgtgcgt

SEQ ID NO: 796302 - DNA, 25 bp, Artificial Sequence
  misc_feature: Description of Artificial Sequence: Synthetic CP.H7 oligonucleotide
gtgctcgatttagcagacgtctgtc

SEQ ID NO: 796303 - DNA, 27 bp, Artificial Sequence
  misc_feature: Description of Artificial Sequence: Synthetic CP.H8 oligonucleotide
ccggtgctcgatttagtatcactcagt

SEQ ID NO: 796304 - DNA, 28 bp, Artificial Sequence
  misc_feature: Description of Artificial Sequence: Synthetic CP.H9 oligonucleotide
accggtgctcgatttagtgctatagact

SEQ ID NO: 796305 - DNA, 25 bp, Artificial Sequence
  misc_feature: Description of Artificial Sequence: Synthetic CP.H10 oligonucleotide
ggtgctcgatttagcagtactgcgt

SEQ ID NO: 796306 - DNA, 22 bp, Artificial Sequence
  misc_feature: Description of Artificial Sequence: Synthetic CP.H11 oligonucleotide
gctcgatttagcgacagcgaga

SEQ ID NO: 796307 - DNA, 22 bp, Artificial Sequence
  misc_feature: Description of Artificial Sequence: Synthetic IgKC_v3 oligonucleotide
cagatggcgggaagatgaagac

SEQ ID NO: 796308 - DNA, 18 bp, Artificial Sequence
  misc_feature: Description of Artificial Sequence: Synthetic IgLC_v5 oligonucleotide
ctcccgggtagaagtcac

SEQ ID NO: 796309 - DNA, 17 bp, Artificial Sequence
  misc_feature: Description of Artificial Sequence: Synthetic IgLC_v6 oligonucleotide
tcccgggtagaagtcac

SEQ ID NO: 796310 - DNA, 17 bp, Artificial Sequence
  misc_feature: Description of Artificial Sequence: Synthetic IgLC_v7 oligonucleotide
gctcccgggtagaagtc

SEQ ID NO: 796311 - DNA, 16 bp, Artificial Sequence
  misc_feature: Description of Artificial Sequence: Synthetic IgLC_v8 oligonucleotide
agtgtggccttgttgg

SEQ ID NO: 796312 - DNA, 19 bp, Artificial Sequence
  misc_feature: Description of Artificial Sequence: Synthetic IgHGC_v10 oligonucleotide
gccagggggaagaccgatg

SEQ ID NO: 796313 - DNA, 17 bp, Artificial Sequence
  misc_feature: Description of Artificial Sequence: Synthetic IgHGC_v11 oligonucleotide
cagggggaagaccgatg

SEQ ID NO: 796314 - DNA, 19 bp, Artificial Sequence
  misc_feature: Description of Artificial Sequence: Synthetic IgHGC_v13 oligonucleotide
aagtagtccttgaccaggc

SEQ ID NO: 796315 - DNA, 20 bp, Artificial Sequence
  misc_feature: Description of Artificial Sequence: Synthetic IgHGC_v15 oligonucleotide
gaagaccgatgggcccttgg

SEQ ID NO: 796316 - DNA, 18 bp, Artificial Sequence
  misc_feature: Description of Artificial Sequence: Synthetic IgHGC_v16 oligonucleotide
aagaccgatgggcccttg

SEQ ID NO: 796317 - DNA, 1 bp, Artificial Sequence
  misc_feature: Description of Artificial Sequence: Synthetic Adaptor_v1 oligonucleotide
g
